United States Patent
Blom et al.

(10) Patent No.: US 10,258,065 B2
(45) Date of Patent: *Apr. 16, 2019

(54) POLYPEPTIDES HAVING XYLANASE ACTIVITY AND POLYNUCLEOTIDES ENCODING SAME

(71) Applicant: Novozymes A/S, Bagsvaerd (DK)

(72) Inventors: Charlotte Blom, Lynge (DK); Ninfa Rangel Pedersen, Soeborg (DK); Dan Pettersson, Lynge (DK); Jens Magnus Eklof, Copenhagen (DK); Kristian Bertel Roemer Krogh, Bagsvaerd (DK); Martin Simon Borchert, Hilleroed (DK); Dorotea Raventos Segura, Rungsted (DK); Nele Ilmberger, Hamburg (DE); Wolfgang Streit, Monkeburg (DE); Jesper Salomon, Holte (DK)

(73) Assignee: Novozymes A/S, Bagsvaerd (DK)

( * ) Notice: Subject to any disclaimer, the term of this patent is extended or adjusted under 35 U.S.C. 154(b) by 0 days.

This patent is subject to a terminal disclaimer.

(21) Appl. No.: 15/323,548

(22) PCT Filed: Jul. 9, 2015

(86) PCT No.: PCT/EP2015/065754
§ 371 (c)(1),
(2) Date: Jan. 3, 2017

(87) PCT Pub. No.: WO2016/005522
PCT Pub. Date: Jan. 14, 2016

(65) Prior Publication Data
US 2017/0202242 A1    Jul. 20, 2017

(30) Foreign Application Priority Data

Jul. 10, 2014  (EP) .................................... 14176473
Sep. 9, 2014   (EP) .................................... 14184066

(51) Int. Cl.
| | | |
|---|---|---|
| *C12N 9/24* | (2006.01) | |
| *A23K 20/189* | (2016.01) | |
| *A23K 10/14* | (2016.01) | |
| *C12P 19/02* | (2006.01) | |
| *C12P 19/14* | (2006.01) | |
| *A23K 20/147* | (2016.01) | |
| *C12N 15/82* | (2006.01) | |
| *A23K 20/10* | (2016.01) | |

(52) U.S. Cl.
CPC ............ *A23K 20/147* (2016.05); *A23K 20/10* (2016.05); *C12N 9/2477* (2013.01); *C12N 9/2482* (2013.01); *C12N 15/8245* (2013.01); *C12P 19/02* (2013.01); *C12P 19/14* (2013.01); *C12Y 302/01008* (2013.01); *C12Y 302/01055* (2013.01); *C07K 2319/02* (2013.01); *C07K 2319/21* (2013.01)

(58) Field of Classification Search
None
See application file for complete search history.

(56) References Cited

U.S. PATENT DOCUMENTS

| | | |
|---|---|---|
| 2008/0233175 A1 | 9/2008 | Steer et al. |
| 2009/0325240 A1 | 12/2009 | Daniell |
| 2011/0111453 A1 | 5/2011 | McBrayer |
| 2015/0079627 A1 | 3/2015 | Rasmussen |

FOREIGN PATENT DOCUMENTS

| | | |
|---|---|---|
| WO | 03/015533 A1 | 2/2003 |
| WO | 2003/062409 A2 | 7/2003 |
| WO | 2005/059084 A1 | 6/2005 |
| WO | 2005/079585 A1 | 9/2005 |
| WO | 2005/121305 A1 | 12/2005 |
| WO | 2006/114095 A1 | 11/2006 |
| WO | 2007/013717 A1 | 2/2007 |
| WO | 2009/108941 A2 | 9/2009 |
| WO | 2009/117689 A1 | 9/2009 |
| WO | 2012/084225 A1 | 6/2012 |
| WO | 2013/068550 A2 | 5/2013 |
| WO | 2014/019220 A1 | 2/2014 |
| WO | 2014/020143 A2 | 2/2014 |
| WO | 2014/081700 A1 | 5/2014 |

OTHER PUBLICATIONS

De Leon et al., "Genetic Improvement of Bioenergy Crops", W. Vermerris (ed.), Springer, New York, 2008, pp. 185-210 (Year: 2008 ).*
Copeland et al., UniProt Accession No. AD3HG6 (2007).
Agger et al., J. Agric. Food Chem., vol. 5, pp. 6141-6148 (2010).
Correia et al., Journal of Biological Chemistry, vol. 286, pp. 22510-22520 (2011).
Ghatge et al., Appl. Microbiol. Biotechnol., vol. 98, No. 10, pp. 4421-4435 (2013).
Huisman et al., Carbohydrate Polymers, vol. 42, pp. 185-191 (2000).
Nishtani et al., Plant Physiol., vol. 87, pp. 883-890 (1988).
Nishtani et al., Journal of Biological Chemistry, vol. 266, No. 10, pp. 6539-6543 (1991).
Polizeli et al., Appl. Microbiol. Biotechnol., vol. 67, No. 5, pp. 577-591 (2005).
Popper et al., Plant Physiology, vol. 153, pp. 373-383 (2010).
Aspeborg et al., BMC Evolutionary Biology, vol. 12, article 186, pp. 1-16 (2012).
Huisman et al., Carbohydrate Polymers, vol. 43, pp. 269-279 (2000).
Lombard et al., Nucleic Acids Research, vol. 42, pp. D490-D495 (2014).
Collins et al., FEMS Microbiology Reviews, vol. 29, pp. 3-23 (2005).

* cited by examiner

*Primary Examiner* — David Steadman
(74) *Attorney, Agent, or Firm* — Elias Lambiris

(57) ABSTRACT

The present invention relates to polypeptides having xylanase activity and polynucleotides encoding the polypeptides. The invention also relates to nucleic acid constructs, vectors, and host cells comprising the polynucleotides as well as methods of producing and using the polypeptides. The invention also relates to compositions comprising the polypeptides of the invention and the use of the polypeptides of the invention to release xylose and in animal feed.

12 Claims, No Drawings

Specification includes a Sequence Listing.

POLYPEPTIDES HAVING XYLANASE ACTIVITY AND POLYNUCLEOTIDES ENCODING SAME

CROSS-REFERENCE TO RELATED APPLICATIONS

This application is a 35 U.S.C. 371 national application of international application no. PCT/EP2015/065754 filed Jul. 9, 2015, which claims priority or the benefit under 35 U.S.C. 119 of International application nos. EP 14176473.8 and EP 14184066.0 filed Jul. 10, 2014 and Sep. 9, 2014, respectively. The content of each application is fully incorporated herein by reference.

REFERENCE TO A SEQUENCE LISTING

This application contains a Sequence Listing in computer readable form, which is incorporated herein by reference.

BACKGROUND OF THE INVENTION

Field of the Invention

The present invention relates to polypeptides having xylanase activity and polynucleotides encoding the polypeptides. The invention also relates to nucleic acid constructs, vectors, and host cells comprising the polynucleotides as well as methods of producing and using the polypeptides. The invention also relates to compositions comprising the polypeptides of the invention and the use of the polypeptides of the invention to release xylose and in animal feed.

Description of the Related Art

Xylans are hemicelluloses found in all land plants (Popper and Tuohy, Plant Physiology, 2010, 153:373-383). They are especially abundant in secondary cell walls and xylem cells. In grasses, with type II cell walls, glucurono arabinoxylans are the main hemicellulose and are present as soluble or insoluble dietary fiber in many grass based food and feed products.

Plant xylans have a β-1,4-linked xylopyranose backbone that can be substituted at the O2 or O3 position with arabinose, glucuronic acid and acetic acid in a species and tissue specific manner. The starch-rich seeds of the Panicoideae with economically important species such as corn and *sorghum* have special types of highly substituted xylans in their cell walls. Compared to wheat flour, wherein over 60% of the xylosyl units in the arabinoxylan backbone are unsubstituted, in corn kernel xylan, the corresponding percentage of unsubstituted backbone xylosyls is 20-30%, and in *sorghum* it is 35-40% (Huismann et al. Carbohydrate Polymers, 2000, 42:269-279). Furthermore, in corn and *sorghum* the xylan side chains can be longer than a single arabinose or glucuronic acid substitution which is common in other xylans. This added side chain complexity is often due to L- and D-galactose and D-xylose sugars bound to the side chain arabinose or glucuronic acid. About every tenth arabinose in corn kernel xylan is also esterified with a ferulic acid and about every fourth xylose carries an acetylation (Agger et al. J. Agric. Food Chem, 2010, 58:6141-6148). All of these factors combined make the highly substituted xylans in corn and *sorghum* resistant to degradation by traditional xylanases.

The known enzymes responsible for the hydrolysis of the xylan backbone are classified into enzyme families based on sequence similarity (cazy.orq). The enzymes with mainly endo-xylanase activity have previously been described in Glycoside hydrolase family (GH) 5, 8, 10, 11 and 30. The enzymes within a family share some characteristics such as 3D fold and they usually share the same reaction mechanism. Some GH families have narrow or mono-specific substrate specificities while other families have broad substrate specificities.

WO2005/003319 suggests the use of polypeptides having glucanase activity, wherein the polypeptide is selected from over 250 different sequences in a multitude of different applications. WO2009/108941 suggests the use of over 500 different polypeptide sequences with many activities, such as cellulase, ligninase, beta glucosidase, hemicellulase, xylanase, alpha-amylase, amyloglucosidase, pectate lyase, cutinase, lipase, pectolyase, or maltogenic alpha amylase activity in a multitude of different applications.

Commercially available GH10 and GH11 xylanases are often used to break down the xylose backbone of arabinoxylan. In animal feed this results in a degradation of the cereal cell wall with a subsequent improvement in nutrient release (starch and protein) encapsulated within the cells. Degradation of xylan also results in the formation of xylose oligomers that may be utilised for hind gut fermentation and therefore can help an animal to obtain more digestible energy. However, such xylanases are sensitive to side chain steric hindrance and whilst they are effective at degrading arabinoxylan from wheat, they are not very effective on the xylan found in the seeds of Panicoideae species, such as corn or *sorghum*.

The result of the hydrolysis of defatted destarched maize (DFDSM, which is maize in which the free starch is removed) using 3 commercially available xylanases is shown in example 6. Example 7 shows the results of the hydrolysis of DFDSM using other known GH10 and GH11 xylanases (such as those disclosed in WO2003/062409, WO2011/057140, WO2005/079585, WO2014/019220, WO2014/020143 and WO 2013/068550). Both examples 6 and 7 show that these prior art xylanases are unable to solubilize (hydrolyze) the branched xylan backbone in maize. Furthermore, as shown in example 8, the GH43 and GH51 arabinofuranosidases disclosed in WO 2006/114095 are also unable to solubilize the branched xylan backbone in maize either alone or in combination with a GH10 or GH11 xylanase.

Corn is used around the world in animal feed and thus there is a need to discover new polypeptides having xylanase activity that are capable of breaking down the highly branched xylan backbone in the cell wall in order to release more xylose and other nutrients which are trapped inside the cell wall. The objective of this invention is to provide xylanases which are able to solubilise this highly branched xylan backbone found in maize.

SUMMARY OF THE INVENTION

The present invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity:

(A) comprises one or more of the following motifs:
  (a) motif I: G[F/Y][A/S][V/G/A/I]HXY[P/V] (SEQ ID NO: 19),
  (b) motif II: [I/L/V][H/I/L/M/V][F/I/Y][D/E][I/L/V]XNEP (SEQ ID NO: 20),
  (c) motif III: [D/G][A/T/W]XX[N/T]X[FILV]R[A/L/M][A/F/H][I/L/M] (SEQ ID NO: 21); or (B) comprises a polypeptide selected from the group consisting of:
  (a) a polypeptide having at least 80% sequence identity to the polypeptide of SEQ ID NO: 3;
  (b) a polypeptide having at least 80% sequence identity to the polypeptide of SEQ ID NO: 9;
  (c) a polypeptide having at least 80% sequence identity to the polypeptide of SEQ ID NO: 15;
  (d) a polypeptide having at least 80% sequence identity to the polypeptide of SEQ ID NO: 27;
  (e) a polypeptide having at least 80% sequence identity to the polypeptide of SEQ ID NO: 39;
  (f) a polypeptide having at least 80% sequence identity to the polypeptide of SEQ ID NO: 45;
  (g) a polypeptide having at least 80% sequence identity to the polypeptide of SEQ ID NO: 67;
  (h) a polypeptide having at least 80% sequence identity to the polypeptide of SEQ ID NO: 73;
  (i) a polypeptide having at least 80% sequence identity to the polypeptide of SEQ ID NO: 79;
  (j) a polypeptide having at least 80% sequence identity to the polypeptide of SEQ ID NO: 85;
  (k) a polypeptide having at least 80% sequence identity to the polypeptide of SEQ ID NO: 91;
  (l) a polypeptide having at least 80% sequence identity to the polypeptide of SEQ ID NO: 97;
  (m) a polypeptide having at least 80% sequence identity to the polypeptide of SEQ ID NO: 103;
  (n) a polypeptide having at least 80% sequence identity to the polypeptide of SEQ ID NO: 109;
  (o) a polypeptide having at least 80% sequence identity to the polypeptide of SEQ ID NO: 115;
  (p) a polypeptide having at least 80% sequence identity to the polypeptide of SEQ ID NO: 121;
  (q) a polypeptide having at least 80% sequence identity to the polypeptide of SEQ ID NO: 127;
  (r) a variant of the polypeptide of SEQ ID NO: 3, SEQ ID NO: 9, SEQ ID NO: 15, SEQ ID NO: 27, SEQ ID NO: 39, SEQ ID NO: 45, SEQ ID NO: 67, SEQ ID NO: 73, SEQ ID NO: 79, SEQ ID NO: 85, SEQ ID NO: 91, SEQ ID NO: 97, SEQ ID NO: 103, SEQ ID NO: 109, SEQ ID NO: 115, SEQ ID NO: 121 or SEQ ID NO: 127 comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions;
  (s) a polypeptide comprising the polypeptide of (a), (b), (c), (d), (e), (f), (g), (h), (i), (j), (k), (l), (m), (n), (o), (p), (q) or (r) and a N-terminal and/or C-terminal His-tag and/or HQ-tag; and
  (t) a fragment of a polypeptide of (a), (b), (c), (d), (e), (f), (g), (h), (i), (j), (k), (l), (m), (n), (o), (p), (q), (r) or (s) having at least 90% of the length of the mature polypeptide; or
(C) comprises the polypeptide of (B) wherein the polypeptide of (B) comprises one or more motifs of (A).

The invention further relates to an isolated polypeptide having xylanase activity, selected from the group consisting of:
  (a) a polypeptide having at least 99.3% sequence identity to the polypeptide of SEQ ID NO: 3;
  (b) a polypeptide having at least 83% sequence identity to the polypeptide of SEQ ID NO: 9;
  (c) a polypeptide having at least 80% sequence identity to the polypeptide of SEQ ID NO: 15;
  (d) a polypeptide having at least 95% sequence identity to the polypeptide of SEQ ID NO: 27;
  (e) a polypeptide having at least 80% sequence identity to the polypeptide of SEQ ID NO: 39;
  (f) a polypeptide having at least 80% sequence identity to the polypeptide of SEQ ID NO: 45;
  (g) a polypeptide having at least 97.5% sequence identity to the polypeptide of SEQ ID NO: 67;
  (h) a polypeptide having at least 98.8% sequence identity to the polypeptide of SEQ ID NO: 73;
  (i) a polypeptide having at least 83% sequence identity to the polypeptide of SEQ ID NO: 79;
  (j) a polypeptide having at least 90% sequence identity to the polypeptide of SEQ ID NO: 85;
  (k) a polypeptide having at least 80% sequence identity to the polypeptide of SEQ ID NO: 91;
  (l) a polypeptide having at least 96% sequence identity to the polypeptide of SEQ ID NO: 97;
  (m) a polypeptide having at least 85% sequence identity to the polypeptide of SEQ ID NO: 103;
  (n) a polypeptide having at least 82% sequence identity to the polypeptide of SEQ ID NO: 109;
  (o) a polypeptide having at least 96% sequence identity to the polypeptide of SEQ ID NO: 115;
  (p) a polypeptide having at least 96% sequence identity to the polypeptide of SEQ ID NO: 121;
  (q) a polypeptide having at least 80% sequence identity to the polypeptide of SEQ ID NO: 127;
  (r) a variant of the polypeptide of SEQ ID NO: 3 wherein the variant has xylanase activity and comprises one or more amino acid substitutions, and/or one or more amino acid deletions, and/or one or more amino acid insertions or any combination thereof in 1, 2, 3 or 4 positions;
  (s) a variant of the polypeptide of SEQ ID NO: 27 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26 or 27 positions;
  (t) a variant of the polypeptide of SEQ ID NO: 67 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13 or 14 positions;
  (u) a variant of the polypeptide of SEQ ID NO: 73 wherein the variant has xylanase activity and comprises one or more amino acid substitutions, and/or one or more amino acid deletions, and/or one or more amino acid insertions or any combination thereof in 1, 2, 3, 4, 5 or 6 positions;
  (v) a variant of the polypeptide of SEQ ID NO: 97, SEQ ID NO: 115 or SEQ ID NO: 121 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20 or 21 positions;
  (w) a variant of the polypeptide of SEQ ID NO: 9, SEQ ID NO: 15, SEQ ID NO: 39, SEQ ID NO: 45, SEQ ID NO: 79, SEQ ID NO: 85, SEQ ID NO: 91, SEQ ID NO: 103, SEQ ID NO: 109 or SEQ ID NO: 127 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions;

(x) a polypeptide comprising the polypeptide of (a), (b), (c), (d), (e), (f), (g), (h), (i), (j), (k), (l), (m), (n), (o), (p), (q), (r), (s), (t), (u), (v) or (w) and a N-terminal and/or C-terminal His-tag and/or HQ-tag; and (y) a fragment of a polypeptide of (a), (b), (c), (d), (e), (f), (g), (h), (i), (j), (k), (l), (m), (n), (o), (p), (q), (r), (s), (t), (u), (v), (w) or (x) having xylanase activity and having at least 90% of the length of the mature polypeptide.

The invention also relates to compositions, such as animal feed or animal feed additives, comprising the polypeptide of the invention; methods of improving the performance of an animal; methods of preparing an animal feed; methods for improving the nutritional value of an animal feed; polynucleotides encoding the polypeptides of the present invention; nucleic acid constructs; expression vectors; recombinant host cells comprising the polynucleotides; methods of producing the polypeptides and uses thereof.

Overview of Sequence Listing

SEQ ID NO: 1 is the DNA sequence of GH5 xylanase as isolated from *Paenibacillus illinoisensis*.

SEQ ID NO: 2 is the amino acid sequence as deduced from SEQ ID NO: 1.

SEQ ID NO: 3 is the amino acid sequence of the mature GH5 xylanase from *Paenibacillus illinoisensis*.

SEQ ID NO: 4 is the DNA sequence of the recombinant expressed DNA sequence from SEQ ID NO: 1 with HQ-tag and Savinase signal peptide.

SEQ ID NO: 5 is the amino acid sequence as deduced from SEQ ID NO: 4.

SEQ ID NO: 6 is the amino acid sequence of the mature GH5 xylanase obtained from SEQ ID NO: 4.

SEQ ID NO: 7 is the DNA sequence of GH5 xylanase as isolated from *Paenibacillus* sp-18054.

SEQ ID NO: 8 is the amino acid sequence as deduced from SEQ ID NO: 7.

SEQ ID NO: 9 is the amino acid sequence of the mature GH5 xylanase from *Paenibacillus* sp-18054.

SEQ ID NO: 10 is the DNA sequence of the recombinant expressed DNA sequence from SEQ ID NO: 7 with His-tag and Savinase signal peptide.

SEQ ID NO: 11 is the amino acid sequence as deduced from SEQ ID NO: 10.

SEQ ID NO: 12 is the amino acid sequence of the mature GH5 xylanase obtained from SEQ ID NO: 10.

SEQ ID NO: 13 is the DNA sequence of GH5 xylanase as isolated from elephant dung metagenome.

SEQ ID NO: 14 is the amino acid sequence as deduced from SEQ ID NO: 13.

SEQ ID NO: 15 is the amino acid sequence of the mature GH5 xylanase from elephant dung metagenome.

SEQ ID NO: 16 is the DNA sequence of the recombinant expressed DNA sequence from SEQ ID NO: 13 with His-tag and Savinase signal peptide.

SEQ ID NO: 17 is the amino acid sequence as deduced from SEQ ID NO: 16.

SEQ ID NO: 18 is the amino acid sequence of the mature GH5 xylanase obtained from SEQ ID NO: 16.

SEQ ID NO: 19 is the GH5 xylanase conserved motif I.

SEQ ID NO: 20 is the GH5 xylanase conserved motif II.

SEQ ID NO: 21 is the GH5 xylanase conserved motif III.

SEQ ID NO: 22 is the *Bacillus clausii* secretion signal.

SEQ ID NO: 23 is the sequence of the His-tag.

SEQ ID NO: 24 is the sequence of the HQ-tag.

SEQ ID NO: 25 is the DNA sequence of GH5 xylanase as isolated from *Chryseobacterium* sp-10696.

SEQ ID NO: 26 is the amino acid sequence as deduced from SEQ ID NO: 25.

SEQ ID NO: 27 is the amino acid sequence of the mature GH5 xylanase from *Chryseobacterium* sp-10696.

SEQ ID NO: 28 is the DNA sequence of the recombinant expressed DNA sequence from SEQ ID NO: 25 with HQ-tag and Savinase signal peptide.

SEQ ID NO: 29 is the amino acid sequence as deduced from SEQ ID NO: 28.

SEQ ID NO: 30 is the amino acid sequence of the mature GH5 xylanase obtained from SEQ ID NO: 29.

SEQ ID NO: 31 is the DNA sequence of GH5 xylanase as isolated from elephant dung metagenome.

SEQ ID NO: 32 is the amino acid sequence as deduced from SEQ ID NO: 31.

SEQ ID NO: 33 is the amino acid sequence of the mature GH5 xylanase from elephant dung metagenome.

SEQ ID NO: 34 is the DNA sequence of the recombinant expressed DNA sequence from SEQ ID NO: 31 with HQ-tag and Savinase signal peptide.

SEQ ID NO: 35 is the amino acid sequence as deduced from SEQ ID NO: 34.

SEQ ID NO: 36 is the amino acid sequence of the mature GH5 xylanase obtained from SEQ ID NO: 34.

SEQ ID NO: 37 is the DNA sequence of GH5 xylanase as isolated from elephant dung metagenome.

SEQ ID NO: 38 is the amino acid sequence as deduced from SEQ ID NO: 37.

SEQ ID NO: 39 is the amino acid sequence of the mature GH5 xylanase from elephant dung metagenome.

SEQ ID NO: 40 is the DNA sequence of the recombinant expressed DNA sequence from SEQ ID NO: 37 with HQ-tag and Savinase signal peptide.

SEQ ID NO: 41 is the amino acid sequence as deduced from SEQ ID NO: 40.

SEQ ID NO: 42 is the amino acid sequence of the mature GH5 xylanase obtained from SEQ ID NO: 40.

SEQ ID NO: 43 is the DNA sequence of GH5 xylanase as isolated from elephant dung metagenome.

SEQ ID NO: 44 is the amino acid sequence as deduced from SEQ ID NO: 43.

SEQ ID NO: 45 is the amino acid sequence of the mature GH5 xylanase from elephant dung metagenome.

SEQ ID NO: 46 is the DNA sequence of the recombinant expressed DNA sequence from SEQ ID NO: 43 with HQ-tag and Savinase signal peptide.

SEQ ID NO: 47 is the amino acid sequence as deduced from SEQ ID NO: 46.

SEQ ID NO: 48 is the amino acid sequence of the mature GH5 xylanase obtained from SEQ ID NO: 46.

SEQ ID NO: 49 is the amino acid sequence of the mature GH10 xylanase from *Aspergillus aculeatus* as disclosed as SEQ ID NO: 5 (XyI II) in WO 1994/021785.

SEQ ID NO: 50 is the amino acid sequence of the mature GH10 xylanase from *Aspergillus aculeatus* as disclosed as SEQ ID NO: 8 in WO 2005/059084.

SEQ ID NO: 51 is the amino acid sequence of the mature GH11 xylanase from *Thermomyces lanuginosus* as disclosed as SEQ ID NO: 2 of WO1996/23062.

SEQ ID NO: 52 is the amino acid sequence of the mature GH11 xylanase from *Dictyoglomus thermophilum* as disclosed as SEQ ID NO: 305 of WO2011/057140.

SEQ ID NO: 53 is the amino acid sequence of the mature GH11 xylanase from *Paenibacillus pabuli* as disclosed as SEQ ID NO: 2 of WO2005/079585.

SEQ ID NO: 54 is the amino acid sequence of the mature GH11 xylanase from *Fusarium oxysporum* (FoxXyn 6) as disclosed as SEQ ID NO: 8 in WO2014/019220.

SEQ ID NO: 55 is the amino acid sequence of the mature GH11 xylanase from *Aspergillus clavatus* (AclXyn5) as disclosed as SEQ ID NO: 8 in WO2014/020143.

SEQ ID NO: 56 is the amino acid sequence of the GH43 arabinofuranosidase from *Humicola insolens* as disclosed as SEQ ID NO: 1 in WO2006/114095.

SEQ ID NO: 57 is the amino acid sequence of the GH51 arabinofuranosidase from *Meripilus giganteus* as disclosed as SEQ ID NO: 2 in WO2006/114095.

SEQ ID NO: 58 is the amino acid sequence of the mature GH10 xylanase from *Thermotoga maritima* MSB8 (XynB) as disclosed as SEQ ID NO: 1 in WO 2013/068550.

SEQ ID NO: 59 is the GH5 xylanase conserved motif I-B.

SEQ ID NO: 60 is the GH5 xylanase conserved motif I-C.

SEQ ID NO: 61 is the GH5 xylanase conserved motif II-B.

SEQ ID NO: 62 is the GH5 xylanase conserved motif II-C.

SEQ ID NO: 63 is the GH5 xylanase conserved motif III-B.

SEQ ID NO: 64 is the GH5 xylanase conserved motif III-C.

SEQ ID NO: 65 is the DNA sequence of GH5 xylanase as isolated from *Paenibacillus campinasensis* (D24B7W).

SEQ ID NO: 66 is the amino acid sequence as deduced from SEQ ID NO: 65 (P34FE8).

SEQ ID NO: 67 is the amino acid sequence of the mature GH5 xylanase from *Paenibacillus campinasensis*.

SEQ ID NO: 68 is the DNA sequence of the recombinant expressed DNA sequence from SEQ ID NO: 65 with HQ-tag and Savinase signal peptide.

SEQ ID NO: 69 is the amino acid sequence as deduced from SEQ ID NO: 68.

SEQ ID NO: 70 is the amino acid sequence of the mature GH5 xylanase obtained from SEQ ID NO: 68.

SEQ ID NO: 71 is the DNA sequence of GH5 xylanase as isolated from *Paenibacillus* sp-62250.

SEQ ID NO: 72 is the amino acid sequence as deduced from SEQ ID NO: 71.

SEQ ID NO: 73 is the amino acid sequence of the mature GH5 xylanase from *Paenibacillus* sp-62250.

SEQ ID NO: 74 is the DNA sequence of the recombinant expressed DNA sequence from SEQ ID NO: 71 with HQ-tag and Savinase signal peptide.

SEQ ID NO: 75 is the amino acid sequence as deduced from SEQ ID NO: 74.

SEQ ID NO: 76 is the amino acid sequence of the mature GH5 xylanase obtained from SEQ ID NO: 74.

SEQ ID NO: 77 is the DNA sequence of GH5 xylanase as isolated from *Paenibacillus favisporus*.

SEQ ID NO: 78 is the amino acid sequence as deduced from SEQ ID NO: 77.

SEQ ID NO: 79 is the amino acid sequence of the mature GH5 xylanase from *Paenibacillus favisporus*.

SEQ ID NO: 80 is the DNA sequence of the recombinant expressed DNA sequence from SEQ ID NO: 77 with HQ-tag and Savinase signal peptide.

SEQ ID NO: 81 is the amino acid sequence as deduced from SEQ ID NO: 80.

SEQ ID NO: 82 is the amino acid sequence of the mature GH5 xylanase obtained from SEQ ID NO: 80.

SEQ ID NO: 83 is the DNA sequence of GH5 xylanase as isolated from *Paenibacillus* tundra.

SEQ ID NO: 84 is the amino acid sequence as deduced from SEQ ID NO: 83.

SEQ ID NO: 85 is the amino acid sequence of the mature GH5 xylanase from *Paenibacillus tundrae*.

SEQ ID NO: 86 is the DNA sequence of the recombinant expressed DNA sequence from SEQ ID NO: 83 with HQ-tag and Savinase signal peptide.

SEQ ID NO: 87 is the amino acid sequence as deduced from SEQ ID NO: 86.

SEQ ID NO: 88 is the amino acid sequence of the mature GH5 xylanase obtained from SEQ ID NO: 86.

SEQ ID NO: 89 is the DNA sequence of GH5 xylanase as isolated from *Paenibacillus* sp-62603.

SEQ ID NO: 90 is the amino acid sequence as deduced from SEQ ID NO: 89.

SEQ ID NO: 91 is the amino acid sequence of the mature GH5 xylanase from *Paenibacillus* sp-62603.

SEQ ID NO: 92 is the DNA sequence of the recombinant expressed DNA sequence from SEQ ID NO: 89 with HQ-tag and Savinase signal peptide.

SEQ ID NO: 93 is the amino acid sequence as deduced from SEQ ID NO: 92.

SEQ ID NO: 94 is the amino acid sequence of the mature GH5 xylanase obtained from SEQ ID NO: 92.

SEQ ID NO: 95 is the DNA sequence of GH5 xylanase as isolated from *Paenibacillus* sp-19179.

SEQ ID NO: 96 is the amino acid sequence as deduced from SEQ ID NO: 95.

SEQ ID NO: 97 is the amino acid sequence of the mature GH5 xylanase from *Paenibacillus* sp-19179.

SEQ ID NO: 98 is the DNA sequence of the recombinant expressed DNA sequence from SEQ ID NO: 95 with HQ-tag and Savinase signal peptide.

SEQ ID NO: 99 is the amino acid sequence as deduced from SEQ ID NO: 98.

SEQ ID NO: 100 is the amino acid sequence of the mature GH5 xylanase obtained from SEQ ID NO: 98.

SEQ ID NO: 101 is the DNA sequence of GH5 xylanase as isolated from *Paenibacillus* sp-62332.

SEQ ID NO: 102 is the amino acid sequence as deduced from SEQ ID NO: 101.

SEQ ID NO: 103 is the amino acid sequence of the mature GH5 xylanase from *Paenibacillus* sp-62332.

SEQ ID NO: 104 is the DNA sequence of the recombinant expressed DNA sequence from SEQ ID NO: 101 with HQ-tag and Savinase signal peptide.

SEQ ID NO: 105 is the amino acid sequence as deduced from SEQ ID NO: 104.

SEQ ID NO: 106 is the amino acid sequence of the mature GH5 xylanase obtained from SEQ ID NO: 104.

SEQ ID NO: 107 is the DNA sequence of GH5 xylanase as isolated from *Paenibacillus* sp-62248.

SEQ ID NO: 108 is the amino acid sequence as deduced from SEQ ID NO: 107.

SEQ ID NO: 109 is the amino acid sequence of the mature GH5 xylanase from *Paenibacillus* sp-62248.

SEQ ID NO: 110 is the DNA sequence of the recombinant expressed DNA sequence from SEQ ID NO: 107 with HQ-tag and Savinase signal peptide.

SEQ ID NO: 111 is the amino acid sequence as deduced from SEQ ID NO: 110.

SEQ ID NO: 112 is the amino acid sequence of the mature GH5 xylanase obtained from SEQ ID NO: 110.

SEQ ID NO: 113 is the DNA sequence of GH5 xylanase as isolated from *Paenibacillus xylanexedens*.

SEQ ID NO: 114 is the amino acid sequence as deduced from SEQ ID NO: 113.

SEQ ID NO: 115 is the amino acid sequence of the mature GH5 xylanase from *Paenibacillus xylanexedens*.

SEQ ID NO: 116 is the DNA sequence of the recombinant expressed DNA sequence from SEQ ID NO: 113 with HQ-tag and Savinase signal peptide.

SEQ ID NO: 117 is the amino acid sequence as deduced from SEQ ID NO: 116.

SEQ ID NO: 118 is the amino acid sequence of the mature GH5 xylanase obtained from SEQ ID NO: 116.

SEQ ID NO: 119 is the DNA sequence of GH5 xylanase as isolated from *Paenibacillus chitinolyticus*.

SEQ ID NO: 120 is the amino acid sequence as deduced from SEQ ID NO: 119.

SEQ ID NO: 121 is the amino acid sequence of the mature GH5 xylanase from *Paenibacillus chitinolyticus*.

SEQ ID NO: 122 is the DNA sequence of the recombinant expressed DNA sequence from SEQ ID NO: 119 with HQ-tag and Savinase signal peptide.

SEQ ID NO: 123 is the amino acid sequence as deduced from SEQ ID NO: 122.

SEQ ID NO: 124 is the amino acid sequence of the mature GH5 xylanase obtained from SEQ ID NO: 122.

SEQ ID NO: 125 is the DNA sequence of GH5 xylanase as isolated from compost metagenome.

SEQ ID NO: 126 is the amino acid sequence as deduced from SEQ ID NO: 125.

SEQ ID NO: 127 is the amino acid sequence of the mature GH5 xylanase from compost metagenome.

SEQ ID NO: 128 is the DNA sequence of the recombinant expressed DNA sequence from SEQ ID NO: 125 with His-tag and Savinase signal peptide.

SEQ ID NO: 129 is the amino acid sequence as deduced from SEQ ID NO: 128.

SEQ ID NO: 130 is the amino acid sequence of the mature GH5 xylanase obtained from SEQ ID NO: 128.

Definitions

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Animal: The term "animal" refers to all animals except humans. Examples of animals are non-ruminants, and ruminants. Ruminant animals include, for example, animals such as sheep, goats, cattle, e.g. beef cattle, cows, and young calves, deer, yank, camel, llama and kangaroo. Non-ruminant animals include mono-gastric animals, e.g. pigs or swine (including, but not limited to, piglets, growing pigs, and sows); poultry such as turkeys, ducks and chicken (including but not limited to broiler chicks, layers); horses (including but not limited to hotbloods, coldbloods and warm bloods), young calves; fish (including but not limited to amberjack, arapaima, barb, bass, bluefish, bocachico, bream, bullhead, cachama, carp, catfish, catla, chanos, char, cichlid, cobia, cod, crappie, dorada, drum, eel, goby, goldfish, gourami, grouper, guapote, halibut, java, labeo, lai, loach, mackerel, milkfish, mojarra, mudfish, mullet, paco, pearlspot, pejerrey, perch, pike, pompano, roach, salmon, sampa, sauger, sea bass, seabream, shiner, sleeper, snakehead, snapper, snook, sole, spinefoot, sturgeon, sunfish, sweetfish, tench, terror, tilapia, trout, tuna, turbot, vendace, walleye and whitefish); and crustaceans (including but not limited to shrimps and prawns).

Animal feed: The term "animal feed" refers to any compound, preparation, or mixture suitable for, or intended for intake by an animal. Animal feed for a mono-gastric animal typically comprises concentrates as well as vitamins, minerals, enzymes, direct fed microbial, amino acids and/or other feed ingredients (such as in a premix) whereas animal feed for ruminants generally comprises forage (including roughage and silage) and may further comprise concentrates as well as vitamins, minerals, enzymes direct fed microbial, amino acid and/or other feed ingredients (such as in a premix).

Arabinoxylan-containing material: The term "Arabinoxylan-containing material" means any material containing arabinoxylan. Arabinoxylan is a hemicellulose found in both the primary and secondary cell walls of plants, including woods and cereal grains, consisting of copolymers of two pentose sugars, arabinose and xylose. The arabinoxylan chain contains a large number of 1,4-linked xylose units. Many xylose units are substituted with 2-, 3- or 2,3-substituted arabinose residues.

Examples of arabinoxylan-containing material are forage, roughage, seeds and grains (either whole or prepared by crushing, milling, etc from e.g. corn, oats, rye, barley, wheat), trees or hard woods (such as poplar, willow, *eucalyptus*, palm, maple, birch), bamboo, herbaceous and/or woody energy crops, agricultural food and feed crops, animal feed products, cassava peels, cocoa pods, sugar cane, sugar beet, locust bean pulp, vegetable or fruit pomaces, wood waste, bark, shavings, sawdust, wood pulp, pulping liquor, waste paper, cardboard, construction and demolition wood waste, industrial or municipal waste water solids or sludge, manure, by-product from brewing and/or fermentation processes, wet distillers grain, dried distillers grain, spent grain, vinasse and bagasse.

Forage as defined herein also includes roughage. Forage is fresh plant material such as hay and silage from forage plants, grass and other forage plants, grass and other forage plants, seaweed, sprouted grains and legumes, or any combination thereof. Examples of forage plants are Alfalfa (Lucerne), birdsfoot trefoil, *brassica* (e.g. kale, rapeseed (canola), rutabaga (swede), turnip), clover (e.g. alsike clover, red clover, subterranean clover, white clover), grass (e.g. Bermuda grass, brome, false oat grass, fescue, heath grass, meadow grasses, *miscanthus*, orchard grass, ryegrass, switchgrass, Timothy-grass), corn (maize), hemp, millet, barley, oats, rye, *sorghum*, soybeans and wheat and vegetables such as beets. Crops suitable for ensilage are the ordinary grasses, clovers, alfalfa, vetches, oats, rye and maize. Forage further includes crop residues from grain production (such as corn stover; straw from wheat, barley, oat, rye and other grains); residues from vegetables like beet tops; residues from oilseed production like stems and leaves form soy beans, rapeseed and other legumes; and fractions from the refining of grains for animal or human consumption or from fuel production or other industries.

Roughage is generally dry plant material with high levels of fiber, such as fiber, bran, husks from seeds and grains and crop residues (such as stover, copra, straw, chaff, sugar beet waste).

Preferred sources of arabinoxylan-containing materials are forage, roughage, seeds and grains, sugar cane, sugar beet and wood pulp.

Body Weight Gain: The term "body weight gain" means an increase in live weight of an animal during a given period of time e.g. the increase in weight from day 1 to day 21.

cDNA: The term "cDNA" means a DNA molecule that can be prepared by reverse transcription from a mature, spliced, mRNA molecule obtained from a eukaryotic or prokaryotic cell. cDNA lacks intron sequences that may be present in the corresponding genomic DNA. The initial, primary RNA transcript is a precursor to mRNA that is processed through a series of steps, including splicing, before appearing as mature spliced mRNA.

Coding sequence: The term "coding sequence" means a polynucleotide, which directly specifies the amino acid sequence of a polypeptide. The boundaries of the coding sequence are generally determined by an open reading frame, which begins with a start codon such as ATG, GTG, or TTG and ends with a stop codon such as TAA, TAG, or TGA. The coding sequence may be a genomic DNA, cDNA, synthetic DNA, or a combination thereof.

Control sequences: The term "control sequences" means nucleic acid sequences necessary for expression of a polynucleotide encoding a mature polypeptide of the present invention. Each control sequence may be native (i.e., from the same gene) or foreign (i.e., from a different gene) to the polynucleotide encoding the polypeptide or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a polypeptide.

Expression: The term "expression" includes any step involved in the production of a polypeptide including, but not limited to, transcription, post-transcriptional modification, translation, post-translational modification, and secretion.

Expression vector: The term "expression vector" means a linear or circular DNA molecule that comprises a polynucleotide encoding a polypeptide and is operably linked to control sequences that provide for its expression.

Feed Conversion Ratio: The term "feed conversion ratio" the amount of feed fed to an animal to increase the weight of the animal by a specified amount. An improved feed conversion ratio means a lower feed conversion ratio. By "lower feed conversion ratio" or "improved feed conversion ratio" it is meant that the use of a feed additive composition in feed results in a lower amount of feed being required to be fed to an animal to increase the weight of the animal by a specified amount compared to the amount of feed required to increase the weight of the animal by the same amount when the feed does not comprise said feed additive composition.

Feed efficiency: The term "feed efficiency" means the amount of weight gain per unit of feed when the animal is fed ad-libitum or a specified amount of food during a period of time. By "increased feed efficiency" it is meant that the use of a feed additive composition according to the present invention in feed results in an increased weight gain per unit of feed intake compared with an animal fed without said feed additive composition being present.

Fragment: The term "fragment" means a polypeptide having one or more (e.g., several) amino acids absent from the amino and/or carboxyl terminus of a mature polypeptide or domain; wherein the fragment has xylanase activity. In one aspect, a fragment contains at least 477 amino acid residues (e.g., amino acids 31 to 507 of SEQ ID NO: 2 or SEQ ID NO: 3), at least 497 amino acid residues (e.g., amino acids 21 to 517 of SEQ ID NO: 2 or SEQ ID NO: 3), or at least 517 amino acid residues (e.g., amino acids 11 to 527 of SEQ ID NO: 2 or SEQ ID NO: 3). In another aspect, a fragment contains at least 486 amino acid residues (e.g., amino acids 31 to 516 of SEQ ID NO: 5 or SEQ ID NO: 6), at least 506 amino acid residues (e.g., amino acids 21 to 526 of SEQ ID NO: 5 or SEQ ID NO: 6), or at least 526 amino acid residues (e.g., amino acids 11 to 536 of SEQ ID NO: 5 or SEQ ID NO: 6).

In one aspect, a fragment contains at least 487 amino acid residues (e.g., amino acids 31 to 517 of SEQ ID NO: 8 or SEQ ID NO: 9), at least 507 amino acid residues (e.g., amino acids 21 to 527 of SEQ ID NO: 8 or SEQ ID NO: 9), or at least 527 amino acid residues (e.g., amino acids 11 to 537 of SEQ ID NO: 8 or SEQ ID NO: 9). In another aspect, a fragment contains at least 495 amino acid residues (e.g., amino acids 31 to 525 of SEQ ID NO: 11 or SEQ ID NO: 12), at least 515 amino acid residues (e.g., amino acids 21 to 535 of SEQ ID NO: 11 or SEQ ID NO: 12), or at least 535 amino acid residues (e.g., amino acids 11 to 545 of SEQ ID NO: 11 or SEQ ID NO: 12).

In one aspect, a fragment contains at least 538 amino acid residues (e.g., amino acids 31 to 568 of SEQ ID NO: 14 or SEQ ID NO: 15), at least 558 amino acid residues (e.g., amino acids 21 to 578 of SEQ ID NO: 14 or SEQ ID NO: 15), or at least 578 amino acid residues (e.g., amino acids 11 to 588 of SEQ ID NO: 14 or SEQ ID NO: 15). In another aspect, a fragment contains at least 546 amino acid residues (e.g., amino acids 31 to 576 of SEQ ID NO: 17 or SEQ ID NO: 18), at least 566 amino acid residues (e.g., amino acids 21 to 586 of SEQ ID NO: 17 or SEQ ID NO: 18), or at least 586 amino acid residues (e.g., amino acids 11 to 596 of SEQ ID NO: 17 or SEQ ID NO: 18).

In one aspect, a fragment contains at least 490 amino acid residues (e.g., amino acids 31 to 520 of SEQ ID NO: 26 or SEQ ID NO: 27), at least 510 amino acid residues (e.g., amino acids 21 to 530 of SEQ ID NO: 26 or SEQ ID NO: 27), or at least 530 amino acid residues (e.g., amino acids 11 to 540 of SEQ ID NO: 26 or SEQ ID NO: 27). In another aspect, a fragment contains at least 498 amino acid residues (e.g., amino acids 31 to 528 of SEQ ID NO: 29 or SEQ ID NO: 30), at least 518 amino acid residues (e.g., amino acids 21 to 538 of SEQ ID NO: 29 or SEQ ID NO: 30), or at least 538 amino acid residues (e.g., amino acids 11 to 548 of SEQ ID NO: 29 or SEQ ID NO: 30).

In one aspect, a fragment contains at least 571 amino acid residues (e.g., amino acids 31 to 601 of SEQ ID NO: 32 or SEQ ID NO: 33), at least 591 amino acid residues (e.g., amino acids 21 to 611 of SEQ ID NO: 32 or SEQ ID NO: 33), or at least 611 amino acid residues (e.g., amino acids 11 to 621 of SEQ ID NO: 32 or SEQ ID NO: 33). In another aspect, a fragment contains at least 579 amino acid residues (e.g., amino acids 31 to 609 of SEQ ID NO: 35 or SEQ ID NO: 36), at least 599 amino acid residues (e.g., amino acids 21 to 619 of SEQ ID NO: 35 or SEQ ID NO: 36), or at least 619 amino acid residues (e.g., amino acids 11 to 629 of SEQ ID NO: 35 or SEQ ID NO: 36).

In one aspect, a fragment contains at least 768 amino acid residues (e.g., amino acids 31 to 798 of SEQ ID NO: 38 or SEQ ID NO: 39), at least 788 amino acid residues (e.g., amino acids 21 to 808 of SEQ ID NO: 38 or SEQ ID NO: 39), or at least 808 amino acid residues (e.g., amino acids 11 to 818 of SEQ ID NO: 38 or SEQ ID NO: 39). In another aspect, a fragment contains at least 776 amino acid residues (e.g., amino acids 31 to 806 of SEQ ID NO: 41 or SEQ ID NO: 42), at least 796 amino acid residues (e.g., amino acids 21 to 816 of SEQ ID NO: 41 or SEQ ID NO: 42), or at least 816 amino acid residues (e.g., amino acids 11 to 826 of SEQ ID NO: 41 or SEQ ID NO: 42).

In one aspect, a fragment contains at least 517 amino acid residues (e.g., amino acids 31 to 547 of SEQ ID NO: 44 or SEQ ID NO: 45), at least 537 amino acid residues (e.g., amino acids 21 to 557 of SEQ ID NO: 44 or SEQ ID NO: 45), or at least 557 amino acid residues (e.g., amino acids 11 to 567 of SEQ ID NO: 44 or SEQ ID NO: 45). In another aspect, a fragment contains at least 525 amino acid residues (e.g., amino acids 31 to 555 of SEQ ID NO: 47 or SEQ ID NO: 48), at least 545 amino acid residues (e.g., amino acids 21 to 565 of SEQ ID NO: 47 or SEQ ID NO: 48), or at least 565 amino acid residues (e.g., amino acids 11 to 575 of SEQ ID NO: 47 or SEQ ID NO: 48).

Highly branched xylan: The term "highly branched xylan" means that more than 50% of xylosyl units in the arabinoxylan backbone are substituted. This is preferably calculated from linkage analysis as performed in Huismann et al. Carbohydrate Polymers, 2000, 42:269-279.

Host cell: The term "host cell" means any cell type that is susceptible to transformation, transfection, transduction, or the like with a nucleic acid construct or expression vector comprising a polynucleotide of the present invention. The term "host cell" encompasses any progeny of a parent cell that is not identical to the parent cell due to mutations that occur during replication.

Isolated: The term "isolated" means a substance in a form or environment that does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., recombinant production in a host cell; multiple copies of a gene encoding the substance; and use of a stronger promoter than the promoter naturally associated with the gene encoding the substance).

Mature polypeptide: The term "mature polypeptide" means a polypeptide in its final form following translation and any post-translational modifications, such as N-terminal processing, C-terminal truncation, glycosylation, phosphorylation, etc. In one aspect, the mature polypeptide is amino acids 1 to 537 of SEQ ID NO: 2 based on the prediction program SignalP (Nielsen et al., 1997, *Protein Engineering* 10: 1-6)] that predicts amino acids −27 to −1 of SEQ ID NO: 2 are a signal peptide. In another aspect, the mature polypeptide is amino acids 1 to 537 of SEQ ID NO: 3. In one aspect, the mature polypeptide is amino acids 1 to 546 of SEQ ID NO: 5 and amino acids −27 to −1 of SEQ ID NO: 5 are a signal peptide. In another aspect, the mature polypeptide is amino acids 1 to 546 of SEQ ID NO: 6.

In one aspect, the mature polypeptide is amino acids 1 to 547 of SEQ ID NO: 8 based on the prediction program SignalP (Nielsen et al., 1997, *Protein Engineering* 10: 1-6)] that predicts amino acids −38 to −1 of SEQ ID NO: 8 are a signal peptide. In another aspect, the mature polypeptide is amino acids 1 to 547 of SEQ ID NO: 9. In one aspect, the mature polypeptide is amino acids 1 to 555 of SEQ ID NO: 11 and amino acids −27 to −1 of SEQ ID NO: 11 are a signal peptide. In another aspect, the mature polypeptide is amino acids 1 to 555 of SEQ ID NO: 12.

In one aspect, the mature polypeptide is amino acids 1 to 598 of SEQ ID NO: 14 based on the prediction program SignalP (Nielsen et al., 1997, *Protein Engineering* 10: 1-6)] that predicts amino acids −26 to −1 of SEQ ID NO: 14 are a signal peptide. In another aspect, the mature polypeptide is amino acids 1 to 598 of SEQ ID NO: 15. In one aspect, the mature polypeptide is amino acids 1 to 606 of SEQ ID NO: 17 and amino acids −27 to −1 of SEQ ID NO: 17 are a signal peptide. In another aspect, the mature polypeptide is amino acids 1 to 606 of SEQ ID NO: 18.

In one aspect, the mature polypeptide is amino acids 1 to 550 of SEQ ID NO: 26 based on the prediction program SignalP (Nielsen et al., 1997, *Protein Engineering* 10: 1-6)] that predicts amino acids −23 to −1 of SEQ ID NO: 26 are a signal peptide. In another aspect, the mature polypeptide is amino acids 1 to 550 of SEQ ID NO: 27. In one aspect, the mature polypeptide is amino acids 1 to 558 of SEQ ID NO: 29 and amino acids −27 to −1 of SEQ ID NO: 29 are a signal peptide. In another aspect, the mature polypeptide is amino acids 1 to 558 of SEQ ID NO: 30.

In one aspect, the mature polypeptide is amino acids 1 to 631 of SEQ ID NO: 32 based on the prediction program SignalP (Nielsen et al., 1997, *Protein Engineering* 10: 1-6)] that predicts amino acids −25 to −1 of SEQ ID NO: 32 are a signal peptide. In another aspect, the mature polypeptide is amino acids 1 to 631 of SEQ ID NO: 33. In one aspect, the mature polypeptide is amino acids 1 to 639 of SEQ ID NO: 35 and amino acids −27 to −1 of SEQ ID NO: 35 are a signal peptide. In another aspect, the mature polypeptide is amino acids 1 to 639 of SEQ ID NO: 36.

In one aspect, the mature polypeptide is amino acids 1 to 828 of SEQ ID NO: 38 based on the prediction program SignalP (Nielsen et al., 1997, *Protein Engineering* 10: 1-6)] that predicts amino acids −18 to −1 of SEQ ID NO: 38 are a signal peptide. In another aspect, the mature polypeptide is amino acids 1 to 828 of SEQ ID NO: 39. In one aspect, the mature polypeptide is amino acids 1 to 836 of SEQ ID NO: 41 and amino acids −27 to −1 of SEQ ID NO: 41 are a signal peptide. In another aspect, the mature polypeptide is amino acids 1 to 836 of SEQ ID NO: 42.

In one aspect, the mature polypeptide is amino acids 1 to 577 of SEQ ID NO: 44 based on the prediction program SignalP (Nielsen et al., 1997, *Protein Engineering* 10: 1-6)] that predicts amino acids −21 to −1 of SEQ ID NO: 44 are a signal peptide. In another aspect, the mature polypeptide is amino acids 1 to 577 of SEQ ID NO: 45. In one aspect, the mature polypeptide is amino acids 1 to 585 of SEQ ID NO: 47 and amino acids −27 to −1 of SEQ ID NO: 47 are a signal peptide. In another aspect, the mature polypeptide is amino acids 1 to 585 of SEQ ID NO: 48.

In one aspect, the mature polypeptide is amino acids 1 to 537 of SEQ ID NO: 66 based on the prediction program SignalP (Nielsen et al., 1997, *Protein Engineering* 10: 1-6)] that predicts amino acids −30 to −1 of SEQ ID NO: 66 are a signal peptide. In another aspect, the mature polypeptide is amino acids 1 to 537 of SEQ ID NO: 67. In one aspect, the mature polypeptide is amino acids 1 to 545 of SEQ ID NO: 69 and amino acids −27 to −1 of SEQ ID NO: 69 are a signal peptide. In another aspect, the mature polypeptide is amino acids 1 to 545 of SEQ ID NO: 70.

In one aspect, the mature polypeptide is amino acids 1 to 536 of SEQ ID NO: 72 based on the prediction program SignalP (Nielsen et al., 1997, *Protein Engineering* 10: 1-6)] that predicts amino acids −32 to −1 of SEQ ID NO: 72 are a signal peptide. In another aspect, the mature polypeptide is amino acids 1 to 536 of SEQ ID NO: 73. In one aspect, the mature polypeptide is amino acids 1 to 544 of SEQ ID NO: 75 and amino acids −27 to −1 of SEQ ID NO: 75 are a signal peptide. In another aspect, the mature polypeptide is amino acids 1 to 544 of SEQ ID NO: 76.

In one aspect, the mature polypeptide is amino acids 1 to 536 of SEQ ID NO: 78 based on the prediction program SignalP (Nielsen et al., 1997, *Protein Engineering* 10: 1-6)] that predicts amino acids −29 to −1 of SEQ ID NO: 78 are a signal peptide. In another aspect, the mature polypeptide is amino acids 1 to 536 of SEQ ID NO: 79. In one aspect, the mature polypeptide is amino acids 1 to 544 of SEQ ID NO: 81 and amino acids −27 to −1 of SEQ ID NO: 81 are a signal peptide. In another aspect, the mature polypeptide is amino acids 1 to 544 of SEQ ID NO: 82.

In one aspect, the mature polypeptide is amino acids 1 to 535 of SEQ ID NO: 84 based on the prediction program SignalP (Nielsen et al., 1997, *Protein Engineering* 10: 1-6)] that predicts amino acids −35 to −1 of SEQ ID NO: 84 are a signal peptide. In another aspect, the mature polypeptide is amino acids 1 to 535 of SEQ ID NO: 85. In one aspect, the mature polypeptide is amino acids 1 to 543 of SEQ ID NO: 87 and amino acids −27 to −1 of SEQ ID NO: 87 are a signal peptide. In another aspect, the mature polypeptide is amino acids 1 to 543 of SEQ ID NO: 88.

In one aspect, the mature polypeptide is amino acids 1 to 536 of SEQ ID NO: 90 based on the prediction program SignalP (Nielsen et al., 1997, *Protein Engineering* 10: 1-6)] that predicts amino acids −32 to −1 of SEQ ID NO: 90 are a signal peptide. In another aspect, the mature polypeptide is amino acids 1 to 536 of SEQ ID NO: 91. In one aspect, the mature polypeptide is amino acids 1 to 544 of SEQ ID NO: 93 and amino acids −27 to −1 of SEQ ID NO: 93 are a signal peptide. In another aspect, the mature polypeptide is amino acids 1 to 544 of SEQ ID NO: 94.

In one aspect, the mature polypeptide is amino acids 1 to 536 of SEQ ID NO: 96 based on the prediction program SignalP (Nielsen et al., 1997, *Protein Engineering* 10: 1-6)] that predicts amino acids −31 to −1 of SEQ ID NO: 96 are a signal peptide. In another aspect, the mature polypeptide is amino acids 1 to 536 of SEQ ID NO: 97. In one aspect, the mature polypeptide is amino acids 1 to 544 of SEQ ID NO: 99 and amino acids −27 to −1 of SEQ ID NO: 99 are a signal peptide. In another aspect, the mature polypeptide is amino acids 1 to 544 of SEQ ID NO: 100.

In one aspect, the mature polypeptide is amino acids 1 to 536 of SEQ ID NO: 102 based on the prediction program SignalP (Nielsen et al., 1997, *Protein Engineering* 10: 1-6)] that predicts amino acids −30 to −1 of SEQ ID NO: 102 are a signal peptide. In another aspect, the mature polypeptide is amino acids 1 to 536 of SEQ ID NO: 103. In one aspect, the mature polypeptide is amino acids 1 to 544 of SEQ ID NO: 105 and amino acids −27 to −1 of SEQ ID NO: 105 are a signal peptide. In another aspect, the mature polypeptide is amino acids 1 to 544 of SEQ ID NO: 106.

In one aspect, the mature polypeptide is amino acids 1 to 536 of SEQ ID NO: 108 based on the prediction program SignalP (Nielsen et al., 1997, *Protein Engineering* 10: 1-6)] that predicts amino acids −29 to −1 of SEQ ID NO: 108 are a signal peptide. In another aspect, the mature polypeptide is amino acids 1 to 536 of SEQ ID NO: 109. In one aspect, the mature polypeptide is amino acids 1 to 544 of SEQ ID NO: 111 and amino acids −27 to −1 of SEQ ID NO: 111 are a signal peptide. In another aspect, the mature polypeptide is amino acids 1 to 544 of SEQ ID NO: 112.

In one aspect, the mature polypeptide is amino acids 1 to 538 of SEQ ID NO: 114 based on the prediction program SignalP (Nielsen et al., 1997, *Protein Engineering* 10: 1-6)] that predicts amino acids −30 to −1 of SEQ ID NO: 114 are a signal peptide. In another aspect, the mature polypeptide is amino acids 1 to 538 of SEQ ID NO: 115. In one aspect, the mature polypeptide is amino acids 1 to 546 of SEQ ID NO: 117 and amino acids −27 to −1 of SEQ ID NO: 117 are a signal peptide. In another aspect, the mature polypeptide is amino acids 1 to 546 of SEQ ID NO: 118.

In one aspect, the mature polypeptide is amino acids 1 to 537 of SEQ ID NO: 120 based on the prediction program SignalP (Nielsen et al., 1997, *Protein Engineering* 10: 1-6)] that predicts amino acids −30 to −1 of SEQ ID NO: 120 are a signal peptide. In another aspect, the mature polypeptide is amino acids 1 to 537 of SEQ ID NO: 121. In one aspect, the mature polypeptide is amino acids 1 to 545 of SEQ ID NO: 123 and amino acids −27 to −1 of SEQ ID NO: 123 are a signal peptide. In another aspect, the mature polypeptide is amino acids 1 to 545 of SEQ ID NO: 124.

In one aspect, the mature polypeptide is amino acids 1 to 537 of SEQ ID NO: 126 based on the prediction program SignalP (Nielsen et al., 1997, *Protein Engineering* 10: 1-6)] that predicts amino acids −29 to −1 of SEQ ID NO: 126 are a signal peptide. In another aspect, the mature polypeptide is amino acids 1 to 536 of SEQ ID NO: 127. In one aspect, the mature polypeptide is amino acids 1 to 544 of SEQ ID NO: 129 and amino acids −27 to −1 of SEQ ID NO: 129 are a signal peptide. In another aspect, the mature polypeptide is amino acids 1 to 544 of SEQ ID NO: 130.

It is known in the art that a host cell may produce a mixture of two of more different mature polypeptides (i.e., with a different C-terminal and/or N-terminal amino acid) expressed by the same polynucleotide. It is also known in the art that different host cells process polypeptides differently, and thus, one host cell expressing a polynucleotide may produce a different mature polypeptide (e.g., having a different C-terminal and/or N-terminal amino acid) as compared to another host cell expressing the same polynucleotide.

Mature polypeptide coding sequence: The term "mature polypeptide coding sequence" means a polynucleotide that encodes a mature polypeptide having xylanase activity. In one aspect, the mature polypeptide coding sequence is nucleotides 82 to 1692 of SEQ ID NO: 1 based on the prediction program SignalP (Nielsen et al., 1997, supra)] that predicts nucleotides 1 to 81 of SEQ ID NO: 1 encode a signal peptide. In another aspect, the mature polypeptide coding sequence is nucleotides 82 to 1719 of SEQ ID NO: 4 and nucleotides 1 to 81 of SEQ ID NO: 4 encode a signal peptide.

In one aspect, the mature polypeptide coding sequence is nucleotides 115 to 1755 of SEQ ID NO: 7 based on the prediction program SignalP (Nielsen et al., 1997, supra)] that predicts nucleotides 1 to 114 of SEQ ID NO: 7 encode a signal peptide. In another aspect, the mature polypeptide coding sequence is nucleotides 82 to 1746 of SEQ ID NO: 10 and nucleotides 1 to 81 of SEQ ID NO: 10 encode a signal peptide.

In one aspect, the mature polypeptide coding sequence is nucleotides 79 to 1872 of SEQ ID NO: 13 based on the prediction program SignalP (Nielsen et al., 1997, supra)] that predicts nucleotides 1 to 78 of SEQ ID NO: 13 encode a signal peptide. In another aspect, the mature polypeptide coding sequence is nucleotides 82 to 1899 of SEQ ID NO: 16 and nucleotides 1 to 81 of SEQ ID NO: 16 encode a signal peptide.

In one aspect, the mature polypeptide coding sequence is nucleotides 70 to 1719 of SEQ ID NO: 25 based on the prediction program SignalP (Nielsen et al., 1997, supra)] that predicts nucleotides 1 to 69 of SEQ ID NO: 25 encode a signal peptide. In another aspect, the mature polypeptide coding sequence is nucleotides 82 to 1755 of SEQ ID NO: 28 and nucleotides 1 to 81 of SEQ ID NO: 28 encode a signal peptide.

In one aspect, the mature polypeptide coding sequence is nucleotides 76 to 1968 of SEQ ID NO: 31 based on the prediction program SignalP (Nielsen et al., 1997, supra)] that predicts nucleotides 1 to 75 of SEQ ID NO: 31 encode a signal peptide. In another aspect, the mature polypeptide coding sequence is nucleotides 82 to 1998 of SEQ ID NO: 34 and nucleotides 1 to 81 of SEQ ID NO: 34 encode a signal peptide.

In one aspect, the mature polypeptide coding sequence is nucleotides 55 to 2538 of SEQ ID NO: 37 based on the prediction program SignalP (Nielsen et al., 1997, supra)] that predicts nucleotides 1 to 54 of SEQ ID NO: 37 encode a signal peptide. In another aspect, the mature polypeptide coding sequence is nucleotides 82 to 2589 of SEQ ID NO: 40 and nucleotides 1 to 81 of SEQ ID NO: 40 encode a signal peptide.

In one aspect, the mature polypeptide coding sequence is nucleotides 64 to 1791 of SEQ ID NO: 43 based on the prediction program SignalP (Nielsen et al., 1997, supra)] that predicts nucleotides 1 to 63 of SEQ ID NO: 43 encode a signal peptide. In another aspect, the mature polypeptide coding sequence is nucleotides 82 to 1836 of SEQ ID NO: 46 and nucleotides 1 to 81 of SEQ ID NO: 46 encode a signal peptide.

Nucleic acid construct: The term "nucleic acid construct" means a nucleic acid molecule, either single- or double-stranded, which is isolated from a naturally occurring gene or is modified to contain segments of nucleic acids in a manner that would not otherwise exist in nature or which is synthetic, which comprises one or more control sequences.

Nutrient Digestibility: The term "nutrient digestibility" means the fraction of a nutrient that disappears from the gastro-intestinal tract or a specified segment of the gastro-intestinal tract, e.g. the small intestine. Nutrient digestibility may be measured as the difference between what is administered to the subject and what. comes out in the faeces of the subject, or between what is administered to the subject and what remains in the digesta on a specified segment of the gastro intestinal tract, e.g. the ileum.

Nutrient digestibility as used herein may be measured by the difference between the intake of a nutrient and the excreted nutrient by means of the total collection of excreta during a period of time; or with the use of an inert marker that is not absorbed by the animal, and allows the researcher calculating the amount of nutrient that disappeared in the entire gastro-intestinal tract or a segment of the gastro-intestinal tract. Such an inert marker may be titanium dioxide, chromic oxide or acid insoluble ash. Digestibility may be expressed as a percentage of the nutrient in the feed, or as mass units of digestible nutrient per mass units of nutrient in the feed. Nutrient digestibility as used herein encompasses starch digestibility, fat digestibility, protein digestibility, and amino acid digestibility.

Energy digestibility as used herein means the gross energy of the feed consumed minus the gross energy of the faeces or the gross energy of the feed consumed minus the gross energy of the remaining digesta on a specified segment of the gastro-intestinal tract of the animal, e.g. the ileum. Metabolizable energy as used herein refers to apparent metabolizable energy and means the gross energy of the feed consumed minus the gross energy contained in the faeces, urine, and gaseous products of digestion. Energy digestibility and metabolizable energy may be measured as the difference between the intake of gross energy and the gross energy excreted in the faeces or the digesta present in specified segment of the gastro-intestinal tract using the same methods to measure the digestibility of nutrients, with appropriate corrections for nitrogen excretion to calculate metabolizable energy of feed.

Operably linked: The term "operably linked" means a configuration in which a control sequence is placed at an appropriate position relative to the coding sequence of a polynucleotide such that the control sequence directs expression of the coding sequence.

Percentage solubilised xylose: The term "percentage solubilised xylose" means the amount of xylose measured in the supernatant after incubation with an enzyme compared to the total amount of xylose present in the substrate before the incubation with the enzyme. For the purpose of the present invention, the percentage solubilised xylose may be calculated using defatted destarched maize (DFDSM) as substrate. DFDSM is prepared according to 'Preparation of Defatted Destarched Maize (DFDSM)' in the experimental section.

The percentage solubilised xylose from defatted destarched maize (DFDSM) may be determined using the reaction conditions 10 mg GH5 polypeptide per kg DFDSM and incubation at 40° C., pH 5 for 4 hours as described in example 3 herein. Thus the term 'is performed under the reaction conditions 10 mg GH5 polypeptide per kg DFDSM and incubation at 40° C., pH 5 for 4 hours' is to be understood that the percentage solubilised xylose is calculated as described in example 3 herein.

In a more detailed embodiment, defatted destarched maize (DFDSM, 400 mg) is added to aqueous sodium acetate (0.1 M, 3.9 mL) solution containing calcium chloride (5 mM) at pH 5 and the mixture is heated to 40° C. for 30 minutes. 100 µL buffer or enzyme solution is added and the sample is heated at 40° C. for 4 hours. The sample is cooled to 5° C. and centrifuged (4000 rpm, 5° C.) for 10 minutes. 1.7 mL of the sample is transferred to an Eppendorf tube and the enzyme is deactivated by heating to 95° C. for 10 minutes. The samples are then frozen until hydrolyzed. The supernatant is thawed and centrifuged (14000 rpm) for 5 minutes. The supernatant (250 µL) is diluted with Milli-Q water (250 µL) in glass tubes and HCl (1.63 M, 2.0 mL) is added. The reaction is heated to 100° C. for 1 hour then cooled in an ice bath. Aqueous NaOH solution (1.3 M, 2.5 mL) is added whilst the samples are cooled on ice and the samples are stored at 0-5° C. whilst xylose content is analysed using the xylose assay. The xylose assay is described in the experimental section.

Sequence Identity: The relatedness between two amino acid sequences or between two nucleotide sequences is described by the parameter "sequence identity".

For purposes of the present invention, the degree of sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 3.0.0 or later. Version 6.1.0 was used. The optional parameters used are gap open penalty of 10, gap extension penalty of 0.5, and the EBLOSUM62 (EMBOSS version of BLOSUM62) substitution matrix. The output of Needle labelled "longest identity" (obtained using the -nobrief option) is used as the percent identity and is calculated as follows:

(Identical Residues×100)/(Length of Alignment−
Total Number of Gaps in Alignment)

For purposes of the present invention, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. Version 6.1.0 was used. The optional parameters used are gap open penalty of 10, gap extension penalty of 0.5, and the EDNAFULL (EMBOSS version of NCBI NUC4.4) substitution matrix. The output of Needle labelled "longest identity" (obtained using the -nobrief option) is used as the percent identity and is calculated as follows:

(Identical Deoxyribonucleotides×100)/(Length of
Alignment−Total Number of Gaps in Alignment)

Stringency conditions: The different stringency conditions are defined as follows.

The term "very low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 2.0×SSC, 0.2% SDS at 60° C.

The term "low stringency conditions" means for probes of at least 100 nucleotides in length, prehybridization and hybridization at 42° C. in 5×SSPE, 0.3% SDS, 200 micrograms/ml sheared and denatured salmon sperm DNA, and 25% formamide, following standard Southern blotting procedures for 12 to 24 hours. The carrier material is finally washed three times each for 15 minutes using 1.0×SSC, 0.2% SDS at 60° C.

The term "medium stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 1.0×SSC, 0.2% SDS at 65° C.

The term "medium-high stringency conditions" means for probes of at least 100 nucleotides in length, prehybridization and hybridization at 42° C. in 5×SSPE, 0.3% SDS, 200 micrograms/ml sheared and denatured salmon sperm DNA, and 35% formamide, following standard Southern blotting procedures for 12 to 24 hours. The carrier material is finally washed three times each for 15 minutes using 1.0×SSC, 0.2% SDS at 70° C.

The term "high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.5×SSC, 0.2% SDS at 70° C.

The term "very high stringency conditions" means for probes of at least 100 nucleotides in length, prehybridization and hybridization at 42° C. in 5×SSPE, 0.3% SDS, 200 micrograms/ml sheared and denatured salmon sperm DNA, and 50% formamide, following standard Southern blotting procedures for 12 to 24 hours. The carrier material is finally washed three times each for 15 minutes using 0.5×SSC, 0.2% SDS at 75° C.

Subsequence: The term "subsequence" means a polynucleotide having one or more (e.g., several) nucleotides absent from the 5' and/or 3' end of a mature polypeptide coding sequence; wherein the subsequence encodes a fragment having xylanase activity. In one aspect, a subsequence contains at least 1431 nucleotides (e.g., nucleotides 172 to 1602 of SEQ ID NO: 1), at least 1491 nucleotides (e.g., nucleotides 142 to 1632 of SEQ ID NO: 1), or at least 1551 nucleotides (e.g., nucleotides 112 to 1662 of SEQ ID NO: 1). In another aspect, a subsequence contains at least 1458 nucleotides (e.g., nucleotides 172 to 1629 of SEQ ID NO: 4), at least 1518 nucleotides (e.g., nucleotides 142 to 1659 of SEQ ID NO: 4), or at least 1578 nucleotides (e.g., nucleotides 112 to 1689 of SEQ ID NO: 4).

In one aspect, a subsequence contains at least 1461 nucleotides (e.g., nucleotides 205 to 1665 of SEQ ID NO: 7), at least 1521 nucleotides (e.g., nucleotides 175 to 1695 of SEQ ID NO: 7), or at least 1581 nucleotides (e.g., nucleotides 145 to 1725 of SEQ ID NO: 7). In another aspect, a subsequence contains at least 1485 nucleotides (e.g., nucleotides 172 to 1656 of SEQ ID NO: 10), at least 1545 nucleotides (e.g., nucleotides 142 to 1686 of SEQ ID NO: 10), or at least 1605 nucleotides (e.g., nucleotides 112 to 1716 of SEQ ID NO: 10).

In one aspect, a subsequence contains at least 1614 nucleotides (e.g., nucleotides 169 to 1782 of SEQ ID NO: 13), at least 1674 nucleotides (e.g., nucleotides 139 to 1812 of SEQ ID NO: 13), or at least 1842 nucleotides (e.g., nucleotides 109 to 1764 of SEQ ID NO: 13). In another aspect, a subsequence contains at least 1638 nucleotides (e.g., nucleotides 172 to 1809 of SEQ ID NO: 16), at least 1698 nucleotides (e.g., nucleotides 142 to 1839 of SEQ ID NO: 16), or at least 1758 nucleotides (e.g., nucleotides 112 to 1869 of SEQ ID NO: 16).

In one aspect, a subsequence contains at least 1470 nucleotides (e.g., nucleotides 160 to 1629 of SEQ ID NO: 25), at least 1530 nucleotides (e.g., nucleotides 130 to 1659 of SEQ ID NO: 25), or at least 1590 nucleotides (e.g., nucleotides 100 to 1689 of SEQ ID NO: 25). In another aspect, a subsequence contains at least 1494 nucleotides (e.g., nucleotides 172 to 1665 of SEQ ID NO: 28), at least 1554 nucleotides (e.g., nucleotides 142 to 1695 of SEQ ID NO: 28), or at least 1614 nucleotides (e.g., nucleotides 112 to 1725 of SEQ ID NO: 28).

In one aspect, a subsequence contains at least 1713 nucleotides (e.g., nucleotides 166 to 1878 of SEQ ID NO: 31), at least 1773 nucleotides (e.g., nucleotides 136 to 1908 of SEQ ID NO: 31), or at least 1833 nucleotides (e.g., nucleotides 106 to 1938 of SEQ ID NO: 31). In another aspect, a subsequence contains at least 1737 nucleotides (e.g., nucleotides 172 to 1908 of SEQ ID NO: 34), at least 1797 nucleotides (e.g., nucleotides 142 to 1938 of SEQ ID NO: 34), or at least 1857 nucleotides (e.g., nucleotides 112 to 1968 of SEQ ID NO: 34).

In one aspect, a subsequence contains at least 2304 nucleotides (e.g., nucleotides 145 to 2448 of SEQ ID NO: 37), at least 2364 nucleotides (e.g., nucleotides 115 to 2478 of SEQ ID NO: 37), or at least 2424 nucleotides (e.g., nucleotides 85 to 2508 of SEQ ID NO: 37). In another aspect, a subsequence contains at least 2328 nucleotides (e.g., nucleotides 172 to 2499 of SEQ ID NO: 40), at least 2388 nucleotides (e.g., nucleotides 142 to 2529 of SEQ ID NO: 40), or at least 2448 nucleotides (e.g., nucleotides 112 to 2559 of SEQ ID NO: 40). In one aspect, a subsequence contains at least 1551 nucleotides (e.g., nucleotides 154 to 1704 of SEQ ID NO: 43), at least 1611 nucleotides (e.g., nucleotides 124 to 1734 of SEQ ID NO: 43), or at least 1671 nucleotides (e.g., nucleotides 94 to 1764 of SEQ ID NO: 43). In another aspect, a subsequence contains at least 1575 nucleotides (e.g., nucleotides 172 to 1746 of SEQ ID NO: 46), at least 1635 nucleotides (e.g., nucleotides 142 to 1776 of SEQ ID NO: 46), or at least 1695 nucleotides (e.g., nucleotides 112 to 1806 of SEQ ID NO: 46).

Substantially pure polypeptide: The term "substantially pure polypeptide" means a preparation that contains at most 10%, at most 8%, at most 6%, at most 5%, at most 4%, at most 3%, at most 2%, at most 1%, and at most 0.5% by weight of other polypeptide material with which it is natively or recombinantly associated. Preferably, the polypeptide is at least 92% pure, e.g., at least 94% pure, at least 95% pure, at least 96% pure, at least 97% pure, at least 98% pure, at least 99%, at least 99.5% pure, and 100% pure by weight of the total polypeptide material present in the preparation. The polypeptides of the present invention are preferably in a substantially pure form. This can be accomplished, for example, by preparing the polypeptide by well-known recombinant methods or by classical purification methods.

Variant: The term "variant" means a polypeptide having xylanase activity comprising an alteration, i.e., a substitution, insertion, and/or deletion of one or more (several) amino acid residues at one or more (several) positions. A substitution means a replacement of an amino acid occupying a position with a different amino acid; a deletion means removal of an amino acid occupying a position; and an insertion means adding 1-3 amino acids adjacent to an amino acid occupying a position. In one aspect, the variants of the present invention have at least 60% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the variants of the present invention have at least 70% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the variants of the present invention have at least 80% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the variants of the present invention have at least 90% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the variants of the present invention have at least 100% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130.

Xylanase: The term "xylanase" means a 1,4-beta-D-xylan-xylohydrolase (E.C. 3.2.1.8) that catalyses the endohydrolysis of 1,4-beta-D-xylosidic linkages in xylans. Xylanase activity can be determined with 0.2% AZCL-arabinoxylan as substrate in 0.01% TRITON® X-100 (a nonionic surfactant) and 200 mM sodium phosphate pH 6 at 37° C. One unit of xylanase activity is defined as 1.0 µmole of azurine produced per minute at 37° C., pH 6 from 0.2% AZCL-arabinoxylan as substrate in 200 mM sodium phosphate pH 6.

In one aspect, the polypeptides of the present invention have at least 60% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the polypeptides of the present invention have at least 70% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the polypeptides of the present invention have at least 80% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the polypeptides of the present invention have at least 90% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130. In one aspect, the polypeptides of the present invention have at least 100% of the xylanase activity of the polypeptide of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130.

Nomenclature

For purposes of the present invention, the nomenclature [Y/F] means that the amino acid at this position may be a tyrosine (Try, Y) or a phenylalanine (Phe, F). Likewise the nomenclature [V/G/A/I] means that the amino acid at this position may be a valine (Val, V), glycine (Gly, G), alanine (Ala, A) or isoleucine (Ile, I), and so forth for other combinations as described herein. The amino acid X is defined such that it may be any of the 20 natural amino acids, unless otherwise stated.

DETAILED DESCRIPTION OF THE INVENTION

The inventors have found that certain xylanases from glycoside hydrolase family 5 (herein referred to as GH5) are surprisingly good at degrading the xylose backbone of sterically hindered arabinoxylan found in plant based material from the sub-family Panicoideae, thereby releasing increased amounts of xylose. Increased degradation, and thereby increased xylose release, can result in advantages for many industries which use plant based material from the sub-family Panicoideae. This is surprising since xylanases from other glycoside hydrolase families (such as GH10 or GH11 either alone or in combination with GH43 or GH51 arabinofuranosidases) that are known to solubilise wheat are unable to solubilise the backbone of sterically hindered arabinoxylan found in plant based material from the sub-family Panicoideae.

The amount of starch present in untreated plant material makes it difficult to detect significant solubilisation of arabinoxylan. Thus model substrates, wherein the starch and fat present in the plant material is removed without effecting the degree of substitution, can be used to aid the determination of improved enzyme combinations over known prior art combinations. One model substrate is defatted destarched maize (DFDSM) and can be prepared as described in the experimental section herein. It is important that the model substrate is not prepared using strongly acidic or basic conditions or high temperatures, since such conditions can remove the side chain carbohydrate molecules and/or ester groups present on the xylan backbone. If these side chain groups are removed, then the complexity and degree of substitution will be reduced resulting in an arabinoxylan material which is easy to degrade by known solutions. It is for this reason that heat, acid and/or base pre-treatment is used in biomass conversion.

The solubilisation of the arabinoxylan can be measured as the amount of xylose released into the supernatant. Increased amounts of solubilisation will result in more xylose being released which can be detected using e.g. the xylose assay method as described herein. Without wishing to be bound by theory, it is believed that increasing the solubilisation of the arabinoxylan opens up the cell walls that can result in the nutrients, such as starch, which are trapped inside being released. The release of starch and other nutrients can result in improved animal performance and/or improve the nutritional value of an animal feed.

The xylanases that have this surprising property comprise one or more of the following motifs:

```
                                              (SEQ ID NO: 19)
(a) motif I:     G[F/Y][A/S][V/G/A]HXY[P/V], (SEQ ID NO: 20)
(b) motif II:    [I/L/V][H/I/L/M/V][F/I/Y][D/E]
and              [I/L/V]XNEP, (SEQ ID NO: 21)
(c) motif III:   [D/G][A/T/W]XX[N/T]X[FILV]R[A/L/M]
                 [A/F/H][I/L/M].
```

As far as the inventors are aware, this motif is only found in xylanases from GH5 subfamily 21 and GH5 subfamily 35. Such motifs are preferably present in the polypeptides of the invention.

Methods of Releasing Xylose
First, Second and Third Aspects

Thus in a first aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity comprises one or more of motif I: G[F/Y][A/S][V/G/A/I]HXY[P/V] (SEQ ID NO: 19). In an embodiment, the amino acid in position 2 of motif I is a tyrosine. In an embodiment, the amino acid in position 3 of motif I is an alanine. In an embodiment, the amino acid in position 4 of motif I is a valine or an isoleucine, preferably a valine. In an embodiment, the amino acid in position 6 of motif I is a tryptophan, a cysteine, isoleucine or an aspartic acid, preferably a tryptophan or a cysteine, more preferably a tryptophan. In an embodiment, the amino acid in position 8 of motif I is a proline. In a more preferred embodiment, the amino acid in position 3 of motif I is an alanine and the amino acid in position 4 of motif I is a valine. In an embodiment, the method is performed under the reaction conditions 10 mg GH5 polypeptide per kg defatted destarched maize (DFDSM) and incubation at 40° C., pH 5 for 4 hours.

In a more preferred embodiment, the GH5 polypeptide comprises one or more of motif I, wherein motif I is G[F/Y][A/S]VH[C/D/I/W]YP (SEQ ID NO: 59), even more preferably motif I is GYAVHWYP (SEQ ID NO: 60). In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif I: G[F/Y][A/S][V/G/A/I]HXY[P/V] (SEQ ID NO: 19) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif I: G[F/Y][A/S]VH[C/D/I/W]YP (SEQ ID NO: 59) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif I: GYAVHWYP (SEQ ID NO: 60) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a second aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity comprises one or more of motif II: [I/L/V][H/I/L/M/V][F/I/Y][D/E][I/L/V]XNEP (SEQ ID NO: 20). In an embodiment, the amino acid in position 1 of motif II is an isoleucine or a valine. In an embodiment, the amino acid in position 2 of motif II is a histidine or a methionine. In an embodiment, the amino acid in position 3 of motif II is an isoleucine or phenylalanine, preferably a phenylalanine. In an embodiment, the amino acid in position 4 of motif II is a glutamic acid. In an embodiment, the amino acid in position 5 of motif II is an isoleucine or a leucine. In an embodiment, the amino acid in position 6 of motif II is an alanine, an isoleucine or a valine. In a more preferred embodiment, the amino acid in position 1 of motif II is an isoleucine or a valine, the amino acid in position 2 of motif II is a histidine or a methionine, the amino acid in position 3 of motif II is an isoleucine or phenylalanine, the amino acid in position 4 of motif II is a glutamic acid, the amino acid in position 5 of motif II is an isoleucine or a leucine and the amino acid in position 6 of motif II is an alanine, an isoleucine or a valine. In an embodiment, the method is performed under the reaction conditions 10 mg GH5 polypeptide per kg DFDSM and incubation at 40° C., pH 5 for 4 hours.

In a more preferred embodiment, the GH5 polypeptide comprises one or more of motif II, wherein motif II is [I/V][H/M][F/I]E[I/L][A/I/V]NEP (SEQ ID NO: 61), even more preferably motif II is VMFE[I/L][A/I/V]NEP (SEQ ID NO: 62). In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif II: [I/L/V/][H/I/L/M/V][F/I/Y][D/E][I/L/V]XNEP (SEQ ID NO: 20) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif II: [I/V][H/M][F/I]E[I/L][A/I/V]NEP (SEQ ID NO: 61) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif II: VMFE[I/L][A/I/V]NEP (SEQ ID NO: 62) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a third aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity comprises one or more of motif III: [D/G][A/T/W]XX[N/T]X[FILV]R[A/L/M][A/F/H][I/L/M] (SEQ ID NO: 21). In an embodiment, the amino acid in position 1 of motif III is a glycine. In an embodiment, the amino acid in position 2 of motif III is a tryptophan. In an embodiment, the amino acid in position 3 of motif III is a lysine, asparagine or tyrosine, preferably an asparagine. In an embodiment, the amino acid in position 4 of motif III is a cysteine, leucine, methionine, serine or valine, preferably a methionine. In an embodiment, the amino acid in position 5 of motif III is an asparagine. In an embodiment, the amino acid in position 6 of motif III is a leucine, glutamine, trypthphan or tyrosine, preferably a glutamine. In an embodiment, the amino acid in position 7 of motif III is an isoleucine, leucine, phenylalanine or valine, preferably a valine. In an embodiment, the amino acid in position 9 of motif III is an alanine or leucine, preferably a leucine. In an embodiment, the amino acid in position 10 of motif III is an alanine, phenylalanine or histidine, preferably a phenylalanine. In an embodiment, the amino acid in position 11 of motif III is an isoleucine or methionine, preferably an isoleucine. In a more preferred embodiment, the amino acid in position 2 of motif III is a tryptophan, the amino acid in position 3 of motif III is an asparagine, the amino acid in position 5 of motif III is a methionine, the amino acid in position 5 of motif III is an asparagine, the amino acid in position 6 of motif III is a glutamine, the amino acid in position 7 of motif III is a valine, the amino acid in position 9 of motif III is a leucine, the amino acid in position 10 of motif III is a phenylalanine and the amino acid in position 11 of motif III is a isoleucine. In an embodiment, the method is performed under the reaction conditions 10 mg GH5 polypeptide per kg DFDSM and incubation at 40° C., pH 5 for 4 hours.

In a more preferred embodiment, the GH5 polypeptide comprises one or more of motif III, wherein motif III is G[A/W][K/N/Y][C/L/M/S/V]N[L/Q/W/Y][FILV]RL[F/H][I/L/M] (SEQ ID NO: 63), even more preferably motif III is GWNMNQVRLFI (SEQ ID NO: 64). In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif III: [D/G][A/T/W]XX[N/T]X[FILV]R[A/L/M][A/F/H][I/L/M] (SEQ ID NO: 21) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif III: G[A/W][K/N/Y][C/L/M/S/V]N[L/Q/W/Y][FILV]RL[F/H][I/L/M] (SEQ ID NO: 63) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

In a preferred embodiment, the GH5 polypeptide having xylanase activity comprising one or more motif III: GWNMNQVRLFI (SEQ ID NO: 64) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours.

Forth Aspect

In a forth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 2 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 2.

In one embodiment, the polypeptide preferably comprises or consists of the amino acid sequence of SEQ ID NO: 2 or an allelic variant thereof; comprises the amino acid sequence of SEQ ID NO: 2 and a N-terminal and/or C-terminal His-tag and/or HQ-tag such as SEQ ID NO: 6 or the mature polypeptide of SEQ ID NO: 5; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 2. In another embodiment, the polypeptide comprises or consists of amino acids 1 to 537 of SEQ ID NO: 2. In another embodiment, the polypeptide comprises or consists of the mature polypeptide of SEQ ID NO: 5. In another embodiment, the polypeptide comprises or consists of amino acids 1 to 546 of SEQ ID NO: 5. In an embodiment, the polypeptide has been isolated.

In a continuation of the forth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 3 of at least 80%. In an embodiment, the GH5 polypeptide has a sequence identity to SEQ ID NO: 3 of at least 85%. In an embodiment, the GH5 polypeptide has a sequence identity to SEQ ID NO: 3 of at least 86%. In an embodiment, the GH5 polypeptide has a sequence identity to SEQ ID NO: 3 of at least 87%. In an embodiment, the GH5 polypeptide has a sequence identity to SEQ ID NO: 3 of at least 88%. In an embodiment, the GH5 polypeptide has a sequence identity to SEQ ID NO: 3 of at least 89%. In an embodiment, the GH5 polypeptide has a sequence identity to SEQ ID NO: 3 of at least 90%. In an embodiment, the GH5 polypeptide has a sequence identity to SEQ ID NO: 3 of at least 91%. In an embodiment, the GH5 polypeptide has a sequence identity to SEQ ID NO: 3 of at least 92%. In an embodiment, the GH5 polypeptide has a sequence identity to SEQ ID NO: 3 of at least 93%. In an embodiment, the GH5 polypeptide has a sequence identity to SEQ ID NO: 3 of at least 94%. In an embodiment, the GH5 polypeptide has a sequence identity to SEQ ID NO: 3 of at least 95%. In an embodiment, the GH5 polypeptide has a sequence identity to SEQ ID NO: 3 of at least 96%. In an embodiment, the GH5 polypeptide has a sequence identity to SEQ ID NO: 3 of at least 97%. In an embodiment, the GH5 polypeptide has a sequence identity to SEQ ID NO: 3 of at least 98%. In an embodiment, the GH5 polypeptide has a sequence identity to SEQ ID NO: 3 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 3. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 6.

In one embodiment, the polypeptide preferably comprises or consists of the amino acid sequence of SEQ ID NO: 3 or an allelic variant thereof; comprises the amino acid sequence of SEQ ID NO: 3 and a N-terminal and/or C-terminal His-tag and/or HQ-tag such as SEQ ID NO: 6; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 3. In another embodiment, the polypeptide comprises or consists of amino acids 1 to 546 of SEQ ID NO: 6. In an embodiment, the polypeptide has been isolated.

In a continuation of the forth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 1, (ii) the mature polypeptide coding sequence of SEQ ID NO: 4, or (iii) the full-length complement of (i) or (ii) (Sambrook et al., 1989, *Molecular Cloning, A Laboratory Manual*, 2d edition, Cold Spring Harbor, New York). In an embodiment, the polypeptide has been isolated.

In a continuation of the forth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 1 or SEQ ID NO: 4 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the forth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 3 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 3 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 3 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 3 is not more than 10, e.g., 1, 2, 3, 4, 5, 6, 7, 8, 9 or 10. In another embodiment, the number of substitutions and/or deletions and/or insertions in SEQ ID NO: 3 is not more than 10, e.g., 1, 2, 3, 4, 5, 6, 7, 8, 9 or 10. In a further embodiment, the number of substitutions in SEQ ID NO: 3 is not more than 10, e.g., 1, 2, 3, 4, 5, 6, 7, 8, 9 or 10. In a further embodiment, the number of conservative substitutions in SEQ ID NO: 3 is not more than 10, e.g., 1, 2, 3, 4, 5, 6, 7, 8, 9 or 10.

The amino acid changes may be of a minor nature, that is conservative amino acid substitutions or insertions that do not significantly affect the folding and/or activity of the protein; small deletions, typically of 1-30 amino acids; small amino- or carboxyl-terminal extensions, such as an amino-terminal methionine residue; a small linker peptide of up to 20-25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, *In, The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Alternatively, the amino acid changes are of such a nature that the physico-chemical properties of the polypeptides are altered. For example, amino acid changes may improve the thermal stability of the polypeptide, alter the substrate specificity, change the pH optimum, and the like.

Essential amino acids in a polypeptide can be identified according to procedures known in the art, such as site-directed mutagenesis or alanine-scanning mutagenesis (Cunningham and Wells, 1989, *Science* 244: 1081-1085). In the latter technique, single alanine mutations are introduced at every residue in the molecule, and the resultant mutant molecules are tested for xylanase activity to identify amino acid residues that are critical to the activity of the molecule. See also, Hilton et al., 1996, *J. Biol. Chem.* 271: 4699-4708. The active site of the enzyme or other biological interaction can also be determined by physical analysis of structure, as determined by such techniques as nuclear magnetic resonance, crystallography, electron diffraction, or photoaffinity labelling, in conjunction with mutation of putative contact site amino acids. See, for example, de Vos et al., 1992, *Science* 255: 306-312; Smith et al., 1992, *J. Mol. Biol.* 224: 899-904; Wlodaver et al., 1992, *FEBS Lett.* 309: 59-64. The identity of essential amino acids can also be inferred from an alignment with a related polypeptide.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, 1988, *Science* 241:

53-57; Bowie and Sauer, 1989, *Proc. Natl. Acad. Sci. USA* 86: 2152-2156; WO 95/17413; or WO 95/22625. Other methods that can be used include error-prone PCR, phage display (e.g., Lowman et al., 1991, *Biochemistry* 30: 10832-10837; U.S. Pat. No. 5,223,409; WO 92/06204), and region-directed mutagenesis (Derbyshire et al., 1986, *Gene* 46: 145; Ner et al., 1988, *DNA* 7: 127).

Mutagenesis/shuffling methods can be combined with high-throughput, automated screening methods to detect activity of cloned, mutagenized polypeptides expressed by host cells (Ness et al., 1999, *Nature Biotechnology* 17: 893-896). Mutagenized DNA molecules that encode active polypeptides can be recovered from the host cells and rapidly sequenced using standard methods in the art. These methods allow the rapid determination of the importance of individual amino acid residues in a polypeptide.

The polypeptide may be a hybrid polypeptide in which a region of one polypeptide is fused at the N-terminus or the C-terminus of a region of another polypeptide.

The polypeptide may be a fusion polypeptide or cleavable fusion polypeptide in which another polypeptide is fused at the N-terminus or the C-terminus of the polypeptide of the present invention. A fusion polypeptide is produced by fusing a polynucleotide encoding another polypeptide to a polynucleotide of the present invention. Techniques for producing fusion polypeptides are known in the art, and include ligating the coding sequences encoding the polypeptides so that they are in frame and that expression of the fusion polypeptide is under control of the same promoter(s) and terminator. Fusion polypeptides may also be constructed using intein technology in which fusion polypeptides are created post-translationally (Cooper et al., 1993, *EMBO J.* 12: 2575-2583; Dawson et al., 1994, *Science* 266: 776-779).

A fusion polypeptide can further comprise a cleavage site between the two polypeptides. Upon secretion of the fusion protein, the site is cleaved releasing the two polypeptides. Examples of cleavage sites include, but are not limited to, the sites disclosed in Martin et al., 2003, *J. Ind. Microbiol. Biotechnol.* 3: 568-576; Svetina et al., 2000, *J. Biotechnol.* 76: 245-251; Rasmussen-Wilson et al., 1997, *Appl. Environ. Microbiol.* 63: 3488-3493; Ward et al., 1995, *Biotechnology* 13: 498-503; and Contreras et al., 1991, *Biotechnology* 9: 378-381; Eaton et al., 1986, *Biochemistry* 25: 505-512; Collins-Racie et al., 1995, *Biotechnology* 13: 982-987; Carter et al., 1989, *Proteins: Structure, Function, and Genetics* 6: 240-248; and Stevens, 2003, *Drug Discovery World* 4: 35-48.

Carbohydrate molecules are often attached to a polypeptide from a fungal source during post-translational modification. In order to aid mass spectrometry analysis, the polypeptide can be incubated with an endoglycosidase to deglycosylate each N-linked position. For every deglycosylated N-linked site, one N-acetyl hexosamine remains on the protein backbone.

Fifth Aspect

In a fifth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 8 of at least 80%, e.g., at least 83%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 8.

In one embodiment, the polypeptide preferably comprises or consists of the amino acid sequence of SEQ ID NO: 8 or an allelic variant thereof; comprises the amino acid sequence of SEQ ID NO: 8 and a N-terminal and/or C-terminal His-tag and/or HQ-tag such as SEQ ID NO: 12 or the mature polypeptide of SEQ ID NO: 11; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 8. In another embodiment, the polypeptide comprises or consists of amino acids 1 to 547 of SEQ ID NO: 8. In another embodiment, the polypeptide comprises or consists of the mature polypeptide of SEQ ID NO: 11. In another embodiment, the polypeptide comprises or consists of amino acids 1 to 555 of SEQ ID NO: 11. In an embodiment, the polypeptide has been isolated.

In a continuation of the fifth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 9 of at least 80%. In an embodiment, the GH5 polypeptide has a sequence identity to SEQ ID NO: 9 of at least 83%. In an embodiment, the GH5 polypeptide has a sequence identity to SEQ ID NO: 9 of at least 85%. In an embodiment, the GH5 polypeptide has a sequence identity to SEQ ID NO: 9 of at least 86%. In an embodiment, the GH5 polypeptide has a sequence identity to SEQ ID NO: 9 of at least 87%. In an embodiment, the GH5 polypeptide has a sequence identity to SEQ ID NO: 9 of at least 88%. In an embodiment, the GH5 polypeptide has a sequence identity to SEQ ID NO: 9 of at least 89%. In an embodiment, the GH5 polypeptide has a sequence identity to SEQ ID NO: 9 of at least 90%. In an embodiment, the GH5 polypeptide has a sequence identity to SEQ ID NO: 9 of at least 91%. In an embodiment, the GH5 polypeptide has a sequence identity to SEQ ID NO: 9 of at least 92%. In an embodiment, the GH5 polypeptide has a sequence identity to SEQ ID NO: 9 of at least 93%. In an embodiment, the GH5 polypeptide has a sequence identity to SEQ ID NO: 9 of at least 94%. In an embodiment, the GH5 polypeptide has a sequence identity to SEQ ID NO: 9 of at least 95%. In an embodiment, the GH5 polypeptide has a sequence identity to SEQ ID NO: 9 of at least 96%. In an embodiment, the GH5 polypeptide has a sequence identity to SEQ ID NO: 9 of at least 97%. In an embodiment, the GH5 polypeptide has a sequence identity to SEQ ID NO: 9 of at least 98%. In an embodiment, the GH5 polypeptide has a sequence identity to SEQ ID NO: 9 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 9. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 12.

In one embodiment, the polypeptide preferably comprises or consists of the amino acid sequence of SEQ ID NO: 9 or an allelic variant thereof; comprises the amino acid sequence of SEQ ID NO: 9 and a N-terminal and/or C-terminal His-tag and/or HQ-tag such as SEQ ID NO: 12; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 547 of SEQ ID NO: 9. In another embodiment, the polypeptide comprises or consists of amino acids 1 to 555 of SEQ ID NO: 12. In an embodiment, the polypeptide has been isolated.

In a continuation of the fifth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 7, (ii) the mature polypeptide coding sequence of SEQ ID NO: 10, or (iii) the full-length complement of (i) or (ii) (Sambrook et al., supra). In an embodiment, the polypeptide has been isolated.

In a continuation of the fifth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 7 or SEQ ID NO: 10 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fifth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 9 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 9 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 9 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 9 is not more than 10, e.g., 1, 2, 3, 4, 5, 6, 7, 8, 9 or 10. In another embodiment, the number of substitutions and/or deletions and/or insertions in SEQ ID NO: 9 is not more than 10, e.g., 1, 2, 3, 4, 5, 6, 7, 8, 9 or 10. In a further embodiment, the number of substitutions in SEQ ID NO: 9 is not more than 10, e.g., 1, 2, 3, 4, 5, 6, 7, 8, 9 or 10. In a further embodiment, the number of conservative substitutions in SEQ ID NO: 9 is not more than 10, e.g., 1, 2, 3, 4, 5, 6, 7, 8, 9 or 10. Examples of amino acid changes, conservative substitutions and fusion peptides are described in the fourth aspect of the invention.

Sixth Aspect

In a sixth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 14 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 14.

In one embodiment, the polypeptide preferably comprises or consists of the amino acid sequence of SEQ ID NO: 14 or an allelic variant thereof; comprises the amino acid sequence of SEQ ID NO: 14 and a N-terminal and/or C-terminal His-tag and/or HQ-tag such as SEQ ID NO: 18 or the mature polypeptide of SEQ ID NO: 17; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 14. In another embodiment, the polypeptide comprises or consists of amino acids 1 to 598 of SEQ ID NO: 14. In another embodiment, the polypeptide comprises or consists of the mature polypeptide of SEQ ID NO: 17. In another embodiment, the polypeptide comprises or consists of amino acids 1 to 606 of SEQ ID NO: 17. In an embodiment, the polypeptide has been isolated.

In a continuation of the sixth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 15 of at least 80%. In an embodiment, the GH5 polypeptide has a sequence identity to SEQ ID NO: 15 of at least 85%. In an embodiment, the GH5 polypeptide has a sequence identity to SEQ ID NO: 15 of at least 86%. In an embodiment, the GH5 polypeptide has a sequence identity to SEQ ID NO: 15 of at least 87%. In an embodiment, the GH5 polypeptide has a sequence identity to SEQ ID NO: 15 of at least 88%. In an embodiment, the GH5 polypeptide has a sequence identity to SEQ ID NO: 15 of at least 89%. In an embodiment, the GH5 polypeptide has a sequence identity to SEQ ID NO: 15 of at least 90%. In an embodiment, the GH5 polypeptide has a sequence identity to SEQ ID NO: 15 of at least 91%. In an embodiment, the GH5 polypeptide has a sequence identity to SEQ ID NO: 15 of at least 92%. In an embodiment, the GH5 polypeptide has a sequence identity to SEQ ID NO: 15 of at least 93%. In an embodiment, the GH5 polypeptide has a sequence identity to SEQ ID NO: 15 of at least 94%. In an embodiment, the GH5 polypeptide has a sequence identity to SEQ ID NO: 15 of at least 95%. In an embodiment, the GH5 polypeptide has a sequence identity to SEQ ID NO: 15 of at least 96%. In an embodiment, the GH5 polypeptide has a sequence identity to SEQ ID NO: 15 of at least 97%. In an embodiment, the GH5 polypeptide has a sequence identity to SEQ ID NO: 15 of at least 98%. In an embodiment, the GH5 polypeptide has a sequence identity to SEQ ID NO: 15 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 15. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 18.

In one embodiment, the polypeptide preferably comprises or consists of the amino acid sequence of SEQ ID NO: 15 or an allelic variant thereof; comprises the amino acid sequence of SEQ ID NO: 15 and a N-terminal and/or C-terminal His-tag and/or HQ-tag such as SEQ ID NO: 18; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 598 of SEQ ID NO: 15. In another embodiment, the polypeptide comprises or consists of amino acids 1 to 606 of SEQ ID NO: 18. In an embodiment, the polypeptide has been isolated.

In a continuation of the sixth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 13, (ii) the mature polypeptide coding sequence of SEQ ID NO: 16, or (iii) the full-length complement of (i) or (ii) (Sambrook et al., supra). In an embodiment, the polypeptide has been isolated.

In a continuation of the sixth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 13 or SEQ ID NO: 16 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the sixth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 15 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 15 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 15 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 15 is not more than 10, e.g., 1, 2, 3, 4, 5, 6, 7, 8, 9 or 10. In another embodiment, the number of substitutions and/or deletions and/or insertions in SEQ ID NO: 15 is not more than 10, e.g., 1, 2, 3, 4, 5, 6, 7, 8, 9 or 10. In a further embodiment, the number of substitutions in SEQ ID NO: 15 is not more than 10, e.g., 1, 2, 3, 4, 5, 6, 7, 8, 9 or 10. In a further embodiment, the number of conservative substitutions in SEQ ID NO: 15 is not more than 10, e.g., 1, 2, 3, 4, 5, 6, 7, 8, 9 or 10. Examples of amino acid changes, conservative substitutions and fusion peptides are described in the fourth aspect of the invention.

Seventh Aspect

In a seventh aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 26 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 26.

In one embodiment, the polypeptide preferably comprises or consists of the amino acid sequence of SEQ ID NO: 26 or an allelic variant thereof; comprises the amino acid sequence of SEQ ID NO: 26 and a N-terminal and/or C-terminal His-tag and/or HQ-tag such as SEQ ID NO: 30 or the mature polypeptide of SEQ ID NO: 29; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 26. In another embodiment, the polypeptide comprises or consists of amino acids 1 to 550 of SEQ ID NO: 26. In another embodiment, the polypeptide comprises or consists of the mature polypeptide of SEQ ID NO: 29. In another embodiment, the polypeptide comprises or consists of amino acids 1 to 558 of SEQ ID NO: 29. In an embodiment, the polypeptide has been isolated.

In a continuation of the seventh aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 27 of at least 80%. In an embodiment, the GH5 polypeptide has a sequence identity to SEQ ID NO: 27 of at least 85%. In an embodiment, the GH5 polypeptide has a sequence identity to SEQ ID NO: 27 of at least 86%. In an embodiment, the GH5 polypeptide has a sequence identity to SEQ ID NO: 27 of at least 87%. In an embodiment, the GH5 polypeptide has a sequence identity to SEQ ID NO: 27 of at least 88%. In an embodiment, the GH5 polypeptide has a sequence identity to SEQ ID NO: 27 of at least 89%. In an embodiment, the GH5 polypeptide has a sequence identity to SEQ ID NO: 27 of at least 90%. In an embodiment, the GH5 polypeptide has a sequence identity to SEQ ID NO: 27 of at least 91%. In an embodiment, the GH5 polypeptide has a sequence identity to SEQ ID NO: 27 of at least 92%. In an embodiment, the GH5 polypeptide has a sequence identity to SEQ ID NO: 27 of at least 93%. In an embodiment, the GH5 polypeptide has a sequence identity to SEQ ID NO: 27 of at least 94%. In an embodiment, the GH5 polypeptide has a sequence identity to SEQ ID NO: 27 of at least 95%. In an embodiment, the GH5 polypeptide has a sequence identity to SEQ ID NO: 27 of at least 96%. In an embodiment, the GH5 polypeptide has a sequence identity to SEQ ID NO: 27 of at least 97%. In an embodiment, the GH5 polypeptide has a sequence identity to SEQ ID NO: 27 of at least 98%. In an embodiment, the GH5 polypeptide has a sequence identity to SEQ ID NO: 27 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 27. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 30.

In one embodiment, the polypeptide preferably comprises or consists of the amino acid sequence of SEQ ID NO: 27 or an allelic variant thereof; comprises the amino acid sequence of SEQ ID NO: 27 and a N-terminal and/or C-terminal His-tag and/or HQ-tag such as SEQ ID NO: 30; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 550 of SEQ ID NO: 27. In another embodiment, the polypeptide comprises or consists of amino acids 1 to 558 of SEQ ID NO: 30. In an embodiment, the polypeptide has been isolated.

In a continuation of the seventh aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 25, (ii) the mature polypeptide coding sequence of SEQ ID NO: 28, or (iii) the full-length complement of (i) or (ii) (Sambrook et al., supra). In an embodiment, the polypeptide has been isolated.

In a continuation of the seventh aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 25 or SEQ ID NO: 28 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the seventh aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 27 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 27 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 27 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 27 is not more than 10, e.g., 1, 2, 3, 4, 5, 6, 7, 8, 9 or 10. In another embodiment, the number of substitutions and/or deletions and/or insertions in SEQ ID NO: 27 is not more than 10, e.g., 1, 2, 3, 4, 5, 6, 7, 8, 9 or 10. In a further embodiment, the number of substitutions in SEQ ID NO: 27 is not more than 10, e.g., 1, 2, 3, 4, 5, 6, 7, 8, 9 or 10. In a further embodiment, the number of conservative substitutions in SEQ ID NO: 27 is not more than 10, e.g., 1, 2, 3, 4, 5, 6, 7, 8, 9 or 10. Examples of amino acid changes, conservative substitutions and fusion peptides are described in the fourth aspect of the invention.

Eighth Aspect

In an eighth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 32 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 32.

In one embodiment, the polypeptide preferably comprises or consists of the amino acid sequence of SEQ ID NO: 32 or an allelic variant thereof; comprises the amino acid sequence of SEQ ID NO: 32 and a N-terminal and/or C-terminal His-tag and/or HQ-tag such as SEQ ID NO: 36 or the mature polypeptide of SEQ ID NO: 35; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 32. In another embodiment, the polypeptide comprises or consists of amino acids 1 to 550 of SEQ ID NO: 32. In another embodiment, the polypeptide comprises or consists of the mature polypeptide of SEQ ID NO: 35. In another embodiment, the polypeptide comprises or consists of amino acids 1 to 558 of SEQ ID NO: 35. In an embodiment, the polypeptide has been isolated.

In a continuation of the eighth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 33 of at least 80%. In an embodiment, the GH5 polypeptide has a sequence identity to SEQ ID NO: 33 of at least 85%. In an embodiment, the GH5 polypeptide has a sequence identity to SEQ ID NO: 33 of at least 86%. In an embodiment, the GH5 polypeptide has a sequence identity to SEQ ID NO: 33 of at least 87%. In an embodiment, the GH5 polypeptide has a sequence identity to SEQ ID NO: 33 of at least 88%. In an embodiment, the GH5 polypeptide has a sequence identity to SEQ ID NO: 33 of at least 89%. In an embodiment, the GH5 polypeptide has a sequence identity to SEQ ID NO: 33 of at least 90%. In an embodiment, the GH5 polypeptide has a sequence identity to SEQ ID NO: 33 of at least 91%. In an embodiment, the GH5 polypeptide has a sequence identity to SEQ ID NO: 33 of at least 92%. In an embodiment, the GH5 polypeptide has a sequence identity to SEQ ID NO: 33 of at least 93%. In an embodiment, the GH5 polypeptide has a sequence identity to SEQ ID NO: 33 of at least 94%. In an embodiment, the GH5 polypeptide has a sequence identity to SEQ ID NO: 33 of at least 95%. In an embodiment, the GH5 polypeptide has a sequence identity to SEQ ID NO: 33 of at least 96%. In an embodiment, the GH5 polypeptide has a sequence identity to SEQ ID NO: 33 of at least 97%. In an embodiment, the GH5 polypeptide has a sequence identity to SEQ ID NO: 33 of at least 98%. In an embodiment, the GH5 polypeptide has a sequence identity to SEQ ID NO: 33 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 33. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 36.

In one embodiment, the polypeptide preferably comprises or consists of the amino acid sequence of SEQ ID NO: 33 or an allelic variant thereof; comprises the amino acid sequence of SEQ ID NO: 33 and a N-terminal and/or C-terminal His-tag and/or HQ-tag such as SEQ ID NO: 36; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 550 of SEQ ID NO: 33. In another embodiment, the polypeptide comprises or consists of amino acids 1 to 558 of SEQ ID NO: 36. In an embodiment, the polypeptide has been isolated.

In a continuation of the eighth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 31, (ii) the mature polypeptide coding sequence of SEQ ID NO: 34, or (iii) the full-length complement of (i) or (ii) (Sambrook et al., supra). In an embodiment, the polypeptide has been isolated.

In a continuation of the eighth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 31 or SEQ ID NO: 34 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eighth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 33 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 33 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 33 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 33 is not more than 10, e.g., 1, 2, 3, 4, 5, 6, 7, 8, 9 or 10. In another embodiment, the number of substitutions and/or deletions and/or insertions in SEQ ID NO: 33 is not more than 10, e.g., 1, 2, 3, 4, 5, 6, 7, 8, 9 or 10. In a further embodiment, the number of substitutions in SEQ ID NO: 33 is not more than 10, e.g., 1, 2, 3, 4, 5, 6, 7, 8, 9 or 10. In a further embodiment, the number of conservative substitutions in SEQ ID NO: 33 is not more than 10, e.g., 1, 2, 3, 4, 5, 6, 7, 8, 9 or 10. Examples of amino acid changes, conservative substitutions and fusion peptides are described in the fourth aspect of the invention.

Ninth Aspect

In a ninth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 38 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 38.

In one embodiment, the polypeptide preferably comprises or consists of the amino acid sequence of SEQ ID NO: 38 or an allelic variant thereof; comprises the amino acid sequence of SEQ ID NO: 38 and a N-terminal and/or C-terminal His-tag and/or HQ-tag such as SEQ ID NO: 42 or the mature polypeptide of SEQ ID NO: 41; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 38. In another embodiment, the polypeptide comprises or consists of amino acids 1 to 828 of SEQ ID NO: 38. In another embodiment, the polypeptide comprises or consists of the mature polypeptide of SEQ ID NO: 41. In another embodiment, the polypeptide comprises or consists of amino acids 1 to 836 of SEQ ID NO: 41. In an embodiment, the polypeptide has been isolated.

In a continuation of the ninth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 39 of at least 80%. In an embodiment, the GH5 polypeptide has a sequence identity to SEQ ID NO: 39 of at least 85%. In an embodiment, the GH5 polypeptide has a sequence identity to SEQ ID NO: 39 of at least 86%. In an embodiment, the GH5 polypeptide has a sequence identity to SEQ ID NO: 39 of at least 87%. In an embodiment, the GH5 polypeptide has a sequence identity to SEQ ID NO: 39 of at least 88%. In an embodiment, the GH5 polypeptide has a sequence identity to SEQ ID NO: 39 of at least 89%. In an embodiment, the GH5 polypeptide has a sequence identity to SEQ ID NO: 39 of at least 90%. In an embodiment, the GH5 polypeptide has a sequence identity to SEQ ID NO: 39 of at least 91%. In an embodiment, the GH5 polypeptide has a sequence identity to SEQ ID NO: 39 of at least 92%. In an embodiment, the GH5 polypeptide has a sequence identity to SEQ ID NO: 39 of at least 93%. In an embodiment, the GH5 polypeptide has a sequence identity to SEQ ID NO: 39 of at least 94%. In an embodiment, the GH5 polypeptide has a sequence identity to SEQ ID NO: 39 of at least 95%. In an embodiment, the GH5 polypeptide has a sequence identity to SEQ ID NO: 39 of at least 96%. In an embodiment, the GH5 polypeptide has a sequence identity to SEQ ID NO: 39 of at least 97%. In an embodiment, the GH5 polypeptide has a sequence identity to SEQ ID NO: 39 of at least 98%. In an embodiment, the GH5 polypeptide has a sequence identity to SEQ ID NO: 39 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 39. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 42.

In one embodiment, the polypeptide preferably comprises or consists of the amino acid sequence of SEQ ID NO: 39 or an allelic variant thereof; comprises the amino acid sequence of SEQ ID NO: 39 and a N-terminal and/or C-terminal His-tag and/or HQ-tag such as SEQ ID NO: 42; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 828 of SEQ ID NO: 39. In another embodiment, the polypeptide comprises or consists of amino acids 1 to 836 of SEQ ID NO: 42. In an embodiment, the polypeptide has been isolated.

In a continuation of the ninth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 37, (ii) the mature polypeptide coding sequence of SEQ ID NO: 40, or (iii) the full-length complement of (i) or (ii) (Sambrook et al., supra). In an embodiment, the polypeptide has been isolated.

In a continuation of the ninth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 37 or SEQ ID NO: 40 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the ninth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 39 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 39 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 39 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 39 is not more than 10, e.g., 1, 2, 3, 4, 5, 6, 7, 8, 9 or 10. In another embodiment, the number of substitutions and/or deletions and/or insertions in SEQ ID NO: 39 is not more than 10, e.g., 1, 2, 3, 4, 5, 6, 7, 8, 9 or 10. In a further embodiment, the number of substitutions in SEQ ID NO: 39 is not more than 10, e.g., 1, 2, 3, 4, 5, 6, 7, 8, 9 or 10. In a further embodiment, the number of conservative substitutions in SEQ ID NO: 39 is not more than 10, e.g., 1, 2, 3, 4, 5, 6, 7, 8, 9 or 10. Examples of amino acid changes, conservative substitutions and fusion peptides are described in the fourth aspect of the invention.

Tenth Aspect

In a tenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 44 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 44.

In one embodiment, the polypeptide preferably comprises or consists of the amino acid sequence of SEQ ID NO: 44 or an allelic variant thereof; comprises the amino acid sequence of SEQ ID NO: 44 and a N-terminal and/or C-terminal His-tag and/or HQ-tag such as SEQ ID NO: 48 or the mature polypeptide of SEQ ID NO: 47; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 44. In another embodiment, the polypeptide comprises or consists of amino acids 1 to 577 of SEQ ID NO: 44. In another embodiment, the polypeptide comprises or consists of the mature polypeptide of SEQ ID NO: 47. In another embodiment, the polypeptide comprises or consists of amino acids 1 to 585 of SEQ ID NO: 47. In an embodiment, the polypeptide has been isolated.

In a continuation of the tenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 45 of at least 80%. In an embodiment, the GH5 polypeptide has a sequence identity to SEQ ID NO: 45 of at least 85%. In an embodiment, the GH5 polypeptide has a sequence identity to SEQ ID NO: 45 of at least 86%. In an embodiment, the GH5 polypeptide has a sequence identity to SEQ ID NO: 45 of at least 87%. In an embodiment, the GH5 polypeptide has a sequence identity to SEQ ID NO: 45 of at least 88%. In an embodiment, the GH5 polypeptide has a sequence identity to SEQ ID NO: 45 of at least 89%. In an embodiment, the GH5 polypeptide has a sequence identity to SEQ ID NO: 45 of at least 90%. In an embodiment, the GH5 polypeptide has a sequence identity to SEQ ID NO: 45 of at least 91%. In an embodiment, the GH5 polypeptide has a sequence identity to SEQ ID NO: 45 of at least 92%. In an embodiment, the GH5 polypeptide has a sequence identity to SEQ ID NO: 45 of at least 93%. In an embodiment, the GH5 polypeptide has a sequence identity to SEQ ID NO: 45 of at least 94%. In an embodiment, the GH5 polypeptide has a sequence identity to SEQ ID NO: 45 of at least 95%. In an embodiment, the GH5 polypeptide has a sequence identity to SEQ ID NO: 45 of at least 96%. In an embodiment, the GH5 polypeptide has a sequence identity to SEQ ID NO: 45 of at least 97%. In an embodiment, the GH5 polypeptide has a sequence identity to SEQ ID NO: 45 of at least 98%. In an embodiment, the GH5 polypeptide has a sequence identity to SEQ ID NO: 45 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 45. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 48.

In one embodiment, the polypeptide preferably comprises or consists of the amino acid sequence of SEQ ID NO: 45 or an allelic variant thereof; comprises the amino acid sequence of SEQ ID NO: 45 and a N-terminal and/or C-terminal His-tag and/or HQ-tag such as SEQ ID NO: 48; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 577 of SEQ ID NO: 45. In another embodiment, the polypeptide comprises or consists of amino acids 1 to 585 of SEQ ID NO: 48. In an embodiment, the polypeptide has been isolated.

In a continuation of the tenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 43, (ii) the mature polypeptide coding sequence of SEQ ID NO: 46, or (iii) the full-length complement of (i) or (ii) (Sambrook et al., supra). In an embodiment, the polypeptide has been isolated.

In a continuation of the tenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 43 or SEQ ID NO: 46 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the tenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 45 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 45 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 45 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 45 is not more than 10, e.g., 1, 2, 3, 4, 5, 6, 7, 8, 9 or 10. In another embodiment, the number of substitutions and/or deletions and/or insertions in SEQ ID NO: 45 is not more than 10, e.g., 1, 2, 3, 4, 5, 6, 7, 8, 9 or 10. In a further embodiment, the number of substitutions in SEQ ID NO: 45 is not more than 10, e.g., 1, 2, 3, 4, 5, 6, 7, 8, 9 or 10. In a further embodiment, the number of conservative substitutions in SEQ ID NO: 45 is not more than 10, e.g., 1, 2, 3, 4, 5, 6, 7, 8, 9 or 10. Examples of amino acid changes, conservative substitutions and fusion peptides are described in the fourth aspect of the invention.

Eleventh Aspect

In an eleventh aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 66 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 66.

In one embodiment, the polypeptide preferably comprises or consists of the amino acid sequence of SEQ ID NO: 66 or an allelic variant thereof; comprises the amino acid sequence of SEQ ID NO: 66 and a N-terminal and/or C-terminal His-tag and/or HQ-tag such as SEQ ID NO: 70 or the mature polypeptide of SEQ ID NO: 69; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 66. In another embodiment, the polypeptide comprises or consists of amino acids 1 to 537 of SEQ ID NO: 66. In another embodiment, the polypeptide comprises or consists of the mature polypeptide of SEQ ID NO: 69. In another embodiment, the polypeptide comprises or consists of amino acids 1 to 545 of SEQ ID NO: 69. In an embodiment, the polypeptide has been isolated.

In a continuation of the eleventh aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 67 of at least 80%. In an embodiment, the GH5 polypeptide has a sequence identity to SEQ ID NO: 67 of at least 85%. In an embodiment, the GH5 polypeptide has a sequence identity to SEQ ID NO: 67 of at least 86%. In an embodiment, the GH5 polypeptide has a sequence identity to SEQ ID NO: 67 of at least 87%. In an embodiment, the GH5 polypeptide has a sequence identity to SEQ ID NO: 67 of at least 88%. In an embodiment, the GH5 polypeptide has a sequence identity to SEQ ID NO: 67 of at least 89%. In an embodiment, the GH5 polypeptide has a sequence identity to SEQ ID NO: 67 of at least 90%. In an embodiment, the GH5 polypeptide has a sequence identity to SEQ ID NO: 67 of at least 91%. In an embodiment, the GH5 polypeptide has a sequence identity to SEQ ID NO: 67 of at least 92%. In an embodiment, the GH5 polypeptide has a sequence identity to SEQ ID NO: 67 of at least 93%. In an embodiment, the GH5 polypeptide has a sequence identity to SEQ ID NO: 67 of at least 94%. In an embodiment, the GH5 polypeptide has a sequence identity to SEQ ID NO: 67 of at least 95%. In an embodiment, the GH5 polypeptide has a sequence identity to SEQ ID NO: 67 of at least 96%. In an embodiment, the GH5 polypeptide has a sequence identity to SEQ ID NO: 67 of at least 97%. In an embodiment, the GH5 polypeptide has a sequence identity to SEQ ID NO: 67 of at least 98%. In an embodiment, the GH5 polypeptide has a sequence identity to SEQ ID NO: 67 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 67. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 70.

In one embodiment, the polypeptide preferably comprises or consists of the amino acid sequence of SEQ ID NO: 67 or an allelic variant thereof; comprises the amino acid sequence of SEQ ID NO: 67 and a N-terminal and/or C-terminal His-tag and/or HQ-tag such as SEQ ID NO: 70; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 67. In another embodiment, the polypeptide comprises or consists of amino acids 1 to 545 of SEQ ID NO: 70. In an embodiment, the polypeptide has been isolated.

In a continuation of the eleventh aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 65, (ii) the mature polypeptide coding sequence of SEQ ID NO: 68, or (iii) the full-length complement of (i) or (ii) (Sambrook et al., supra). In an embodiment, the polypeptide has been isolated.

In a continuation of the eleventh aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 65 or SEQ ID NO: 68 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eleventh aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 67 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 67 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 67 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 67 is not more than 10, e.g., 1, 2, 3, 4, 5, 6, 7, 8, 9 or 10. In another embodiment, the number of substitutions and/or deletions and/or insertions in SEQ ID NO: 67 is not more than 10, e.g., 1, 2, 3, 4, 5, 6, 7, 8, 9 or 10. In a further embodiment, the number of substitutions in SEQ ID NO: 67 is not more than 10, e.g., 1, 2, 3, 4, 5, 6, 7, 8, 9 or 10. In a further embodiment, the number of conservative substitutions in SEQ ID NO: 67 is not more than 10, e.g., 1, 2, 3, 4, 5, 6, 7, 8, 9 or 10. Examples of amino acid changes, conservative substitutions and fusion peptides are described in the fourth aspect of the invention.

Twelfth Aspect

In a twelfth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 72 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 72.

In one embodiment, the polypeptide preferably comprises or consists of the amino acid sequence of SEQ ID NO: 72 or an allelic variant thereof; comprises the amino acid sequence of SEQ ID NO: 72 and a N-terminal and/or C-terminal His-tag and/or HQ-tag such as SEQ ID NO: 76 or the mature polypeptide of SEQ ID NO: 75; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 72. In another embodiment, the polypeptide comprises or consists of amino acids 1 to 536 of SEQ ID NO: 72. In another embodiment, the polypeptide comprises or consists of the mature polypeptide of SEQ ID NO: 75. In another embodiment, the polypeptide comprises or consists of amino acids 1 to 544 of SEQ ID NO: 75. In an embodiment, the polypeptide has been isolated.

In a continuation of the twelfth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 73 of at least 80%. In an embodiment, the GH5 polypeptide has a sequence identity to SEQ ID NO: 73 of at least 85%. In an embodiment, the GH5 polypeptide has a sequence identity to SEQ ID NO: 73 of at least 86%. In an embodiment, the GH5 polypeptide has a sequence identity to SEQ ID NO: 73 of at least 87%. In an embodiment, the GH5 polypeptide has a sequence identity to SEQ ID NO: 73 of at least 88%. In an embodiment, the GH5 polypeptide has a sequence identity to SEQ ID NO: 73 of at least 89%. In an embodiment, the GH5 polypeptide has a sequence identity to SEQ ID NO: 73 of at least 90%. In an embodiment, the GH5 polypeptide has a sequence identity to SEQ ID NO: 73 of at least 91%. In an embodiment, the GH5 polypeptide has a sequence identity to SEQ ID NO: 73 of at least 92%. In an embodiment, the GH5 polypeptide has a sequence identity to SEQ ID NO: 73 of at least 93%. In an embodiment, the GH5 polypeptide has a sequence identity to SEQ ID NO: 73 of at least 94%. In an embodiment, the GH5 polypeptide has a sequence identity to SEQ ID NO: 73 of at least 95%. In an embodiment, the GH5 polypeptide has a sequence identity to SEQ ID NO: 73 of at least 96%. In an embodiment, the GH5 polypeptide has a sequence identity to SEQ ID NO: 73 of at least 97%. In an embodiment, the GH5 polypeptide has a sequence identity to SEQ ID NO: 73 of at least 98%. In an embodiment, the GH5 polypeptide has a sequence identity to SEQ ID NO: 73 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 73. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 76.

In one embodiment, the polypeptide preferably comprises or consists of the amino acid sequence of SEQ ID NO: 73 or an allelic variant thereof; comprises the amino acid sequence of SEQ ID NO: 73 and a N-terminal and/or C-terminal His-tag and/or HQ-tag such as SEQ ID NO: 76; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 73. In another embodiment, the polypeptide comprises or consists of amino acids 1 to 544 of SEQ ID NO: 76. In an embodiment, the polypeptide has been isolated.

In a continuation of the twelfth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 71, (ii) the mature polypeptide coding sequence of SEQ ID NO: 74, or (iii) the full-length complement of (i) or (ii) (Sambrook et al., supra). In an embodiment, the polypeptide has been isolated.

In a continuation of the twelfth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 71 or SEQ ID NO: 74 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twelfth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 73 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 73 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 73 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 73 is not more than 10, e.g., 1, 2, 3, 4, 5, 6, 7, 8, 9 or 10. In another embodiment, the number of substitutions and/or deletions and/or insertions in SEQ ID NO: 73 is not more than 10, e.g., 1, 2, 3, 4, 5, 6, 7, 8, 9 or 10. In a further embodiment, the number of substitutions in SEQ ID NO: 73 is not more than 10, e.g., 1, 2, 3, 4, 5, 6, 7, 8, 9 or 10. In a further embodiment, the number of conservative substitutions in SEQ ID NO: 73 is not more than 10, e.g., 1, 2, 3, 4, 5, 6, 7, 8, 9 or 10. Examples of amino acid changes, conservative substitutions and fusion peptides are described in the fourth aspect of the invention.

Thirteenth Aspect

In a thirteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 78 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 78.

In one embodiment, the polypeptide preferably comprises or consists of the amino acid sequence of SEQ ID NO: 78 or an allelic variant thereof; comprises the amino acid sequence of SEQ ID NO: 78 and a N-terminal and/or C-terminal His-tag and/or HQ-tag such as SEQ ID NO: 82 or the mature polypeptide of SEQ ID NO: 81; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 78. In another embodiment, the polypeptide comprises or consists of amino acids 1 to 536 of SEQ ID NO: 78. In another embodiment, the polypeptide comprises or consists of the mature polypeptide of SEQ ID NO: 81. In another embodiment, the polypeptide comprises or consists of amino acids 1 to 544 of SEQ ID NO: 81. In an embodiment, the polypeptide has been isolated.

In a continuation of the thirteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 79 of at least 80%. In an embodiment, the GH5 polypeptide has a sequence identity to SEQ ID NO: 79 of at least 85%. In an embodiment, the GH5 polypeptide has a sequence identity to SEQ ID NO: 79 of at least 86%. In an embodiment, the GH5 polypeptide has a sequence identity to SEQ ID NO: 79 of at least 87%. In an embodiment, the GH5 polypeptide has a sequence identity to SEQ ID NO: 79 of at least 88%. In an embodiment, the GH5 polypeptide has a sequence identity to SEQ ID NO: 79 of at least 89%. In an embodiment, the GH5 polypeptide has a sequence identity to SEQ ID NO: 79 of at least 90%. In an embodiment, the GH5 polypeptide has a sequence identity to SEQ ID NO: 79 of at least 91%. In an embodiment, the GH5 polypeptide has a sequence identity to SEQ ID NO: 79 of at least 92%. In an embodiment, the GH5 polypeptide has a sequence identity to SEQ ID NO: 79 of at least 93%. In an embodiment, the GH5 polypeptide has a sequence identity to SEQ ID NO: 79 of at least 94%. In an embodiment, the GH5 polypeptide has a sequence identity to SEQ ID NO: 79 of at least 95%. In an embodiment, the GH5 polypeptide has a sequence identity to SEQ ID NO: 79 of at least 96%. In an embodiment, the GH5 polypeptide has a sequence identity to SEQ ID NO: 79 of at least 97%. In an embodiment, the GH5 polypeptide has a sequence identity to SEQ ID NO: 79 of at least 98%. In an embodiment, the GH5 polypeptide has a sequence identity to SEQ ID NO: 79 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 79. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 82.

In one embodiment, the polypeptide preferably comprises or consists of the amino acid sequence of SEQ ID NO: 79 or an allelic variant thereof; comprises the amino acid sequence of SEQ ID NO: 79 and a N-terminal and/or C-terminal His-tag and/or HQ-tag such as SEQ ID NO: 82; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 79. In another embodiment, the polypeptide comprises or consists of amino acids 1 to 544 of SEQ ID NO: 82. In an embodiment, the polypeptide has been isolated.

In a continuation of the thirteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 77, (ii) the mature polypeptide coding sequence of SEQ ID NO: 80, or (iii) the full-length complement of (i) or (ii) (Sambrook et al., supra). In an embodiment, the polypeptide has been isolated.

In a continuation of the thirteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 77 or SEQ ID NO: 80 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 79 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 79 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 79 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 79 is not more than 10, e.g., 1, 2, 3, 4, 5, 6, 7, 8, 9 or 10. In another embodiment, the number of substitutions and/or deletions and/or insertions in SEQ ID NO: 79 is not more than 10, e.g., 1, 2, 3, 4, 5, 6, 7, 8, 9 or 10. In a further embodiment, the number of substitutions in SEQ ID NO: 79 is not more than 10, e.g., 1, 2, 3, 4, 5, 6, 7, 8, 9 or 10. In a further embodiment, the number of conservative substitutions in SEQ ID NO: 79 is not more than 10, e.g., 1, 2, 3, 4, 5, 6, 7, 8, 9 or 10. Examples of amino acid changes, conservative substitutions and fusion peptides are described in the fourth aspect of the invention.

Fourteenth Aspect

In a fourteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 84 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 84.

In one embodiment, the polypeptide preferably comprises or consists of the amino acid sequence of SEQ ID NO: 84 or an allelic variant thereof; comprises the amino acid sequence of SEQ ID NO: 84 and a N-terminal and/or C-terminal His-tag and/or HQ-tag such as SEQ ID NO: 87; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 84. In another embodiment, the polypeptide comprises or consists of amino acids 1 to 535 of SEQ ID NO: 84. In another embodiment, the polypeptide comprises or consists of the mature polypeptide of SEQ ID NO: 87. In another embodiment, the polypeptide comprises or consists of amino acids 1 to 543 of SEQ ID NO: 87. In an embodiment, the polypeptide has been isolated.

In a continuation of the fourteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 85 of at least 80%. In an embodiment, the GH5 polypeptide has a sequence identity to SEQ ID NO: 85 of at least 85%. In an embodiment, the GH5 polypeptide has a sequence identity to SEQ ID NO: 85 of at least 86%. In an embodiment, the GH5 polypeptide has a sequence identity to SEQ ID NO: 85 of at least 87%. In an embodiment, the GH5 polypeptide has a sequence identity to SEQ ID NO: 85 of at least 88%. In an embodiment, the GH5 polypeptide has a sequence identity to SEQ ID NO: 85 of at least 89%. In an embodiment, the GH5 polypeptide has a sequence identity to SEQ ID NO: 85 of at least 90%. In an embodiment, the GH5 polypeptide has a sequence identity to SEQ ID NO: 85 of at least 91%. In an embodiment, the GH5 polypeptide has a sequence identity to SEQ ID NO: 85 of at least 92%. In an embodiment, the GH5 polypeptide has a sequence identity to SEQ ID NO: 85 of at least 93%. In an embodiment, the GH5 polypeptide has a sequence identity to SEQ ID NO: 85 of at least 94%. In an embodiment, the GH5 polypeptide has a sequence identity to SEQ ID NO: 85 of at least 95%. In an embodiment, the GH5 polypeptide has a sequence identity to SEQ ID NO: 85 of at least 96%. In an embodiment, the GH5 polypeptide has a sequence identity to SEQ ID NO: 85 of at least 97%. In an embodiment, the GH5 polypeptide has a sequence identity to SEQ ID NO: 85 of at least 98%. In an embodiment, the GH5 polypeptide has a sequence identity to SEQ ID NO: 85 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 85. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 88.

In one embodiment, the polypeptide preferably comprises or consists of the amino acid sequence of SEQ ID NO: 85 or an allelic variant thereof; comprises the amino acid sequence of SEQ ID NO: 85 and a N-terminal and/or C-terminal His-tag and/or HQ-tag such as SEQ ID NO: 88; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 535 of SEQ ID NO: 85. In another embodiment, the polypeptide comprises or consists of amino acids 1 to 543 of SEQ ID NO: 88. In an embodiment, the polypeptide has been isolated.

In a continuation of the fourteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 83, (ii) the mature polypeptide coding sequence of SEQ ID NO: 86, or (iii) the full-length complement of (i) or (ii) (Sambrook et al., supra). In an embodiment, the polypeptide has been isolated.

In a continuation of the fourteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 83 or SEQ ID NO: 86 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fourteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 85 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 85 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 85 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 85 is not more than 10, e.g., 1, 2, 3, 4, 5, 6, 7, 8, 9 or 10. In another embodiment, the number of substitutions and/or deletions and/or insertions in SEQ ID NO: 85 is not more than 10, e.g., 1, 2, 3, 4, 5, 6, 7, 8, 9 or 10. In a further embodiment, the number of substitutions in SEQ ID NO: 85 is not more than 10, e.g., 1, 2, 3, 4, 5, 6, 7, 8, 9 or 10. In a further embodiment, the number of conservative substitutions in SEQ ID NO: 85 is not more than 10, e.g., 1, 2, 3, 4, 5, 6, 7, 8, 9 or 10. Examples of amino acid changes, conservative substitutions and fusion peptides are described in the fourth aspect of the invention.

Fifteenth Aspect

In a fifteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 90 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 90.

In one embodiment, the polypeptide preferably comprises or consists of the amino acid sequence of SEQ ID NO: 90 or an allelic variant thereof; comprises the amino acid sequence of SEQ ID NO: 90 and a N-terminal and/or C-terminal His-tag and/or HQ-tag such as SEQ ID NO: 94 or the mature polypeptide of SEQ ID NO: 93; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 90. In another embodiment, the polypeptide comprises or consists of amino acids 1 to 536 of SEQ ID NO: 90. In another embodiment, the polypeptide comprises or consists of the mature polypeptide of SEQ ID NO: 93. In another embodiment, the polypeptide comprises or consists of amino acids 1 to 566 of SEQ ID NO: 93. In an embodiment, the polypeptide has been isolated.

In a continuation of the fifteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 91 of at least 80%. In an embodiment, the GH5 polypeptide has a sequence identity to SEQ ID NO: 91 of at least 85%. In an embodiment, the GH5 polypeptide has a sequence identity to SEQ ID NO: 91 of at least 86%. In an embodiment, the GH5 polypeptide has a sequence identity to SEQ ID NO: 91 of at least 87%. In an embodiment, the GH5 polypeptide has a sequence identity to SEQ ID NO: 91 of at least 88%. In an embodiment, the GH5 polypeptide has a sequence identity to SEQ ID NO: 91 of at least 89%. In an embodiment, the GH5 polypeptide has a sequence identity to SEQ ID NO: 91 of at least 90%. In an embodiment, the GH5 polypeptide has a sequence identity to SEQ ID NO: 91 of at least 91%. In an embodiment, the GH5 polypeptide has a sequence identity to SEQ ID NO: 91 of at least 92%. In an embodiment, the GH5 polypeptide has a sequence identity to SEQ ID NO: 91 of at least 93%. In an embodiment, the GH5 polypeptide has a sequence identity to SEQ ID NO: 91 of at least 94%. In an embodiment, the GH5 polypeptide has a sequence identity to SEQ ID NO: 91 of at least 95%. In an embodiment, the GH5 polypeptide has a sequence identity to SEQ ID NO: 91 of at least 96%. In an embodiment, the GH5 polypeptide has a sequence identity to SEQ ID NO: 91 of at least 97%. In an embodiment, the GH5 polypeptide has a sequence identity to SEQ ID NO: 91 of at least 98%. In an embodiment, the GH5 polypeptide has a sequence identity to SEQ ID NO: 91 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 91. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 94.

In one embodiment, the polypeptide preferably comprises or consists of the amino acid sequence of SEQ ID NO: 91 or an allelic variant thereof; comprises the amino acid sequence of SEQ ID NO: 91 and a N-terminal and/or C-terminal His-tag and/or HQ-tag such as SEQ ID NO: 94;

or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 91. In another embodiment, the polypeptide comprises or consists of amino acids 1 to 566 of SEQ ID NO: 94. In an embodiment, the polypeptide has been isolated.

In a continuation of the fifteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 89, (ii) the mature polypeptide coding sequence of SEQ ID NO: 92, or (iii) the full-length complement of (i) or (ii) (Sambrook et al., supra). In an embodiment, the polypeptide has been isolated.

In a continuation of the fifteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 89 or SEQ ID NO: 92 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the fifteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 91 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 91 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 91 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 91 is not more than 10, e.g., 1, 2, 3, 4, 5, 6, 7, 8, 9 or 10. In another embodiment, the number of substitutions and/or deletions and/or insertions in SEQ ID NO: 91 is not more than 10, e.g., 1, 2, 3, 4, 5, 6, 7, 8, 9 or 10. In a further embodiment, the number of substitutions in SEQ ID NO: 91 is not more than 10, e.g., 1, 2, 3, 4, 5, 6, 7, 8, 9 or 10. In a further embodiment, the number of conservative substitutions in SEQ ID NO: 91 is not more than 10, e.g., 1, 2, 3, 4, 5, 6, 7, 8, 9 or 10. Examples of amino acid changes, conservative substitutions and fusion peptides are described in the fourth aspect of the invention.

Sixteenth Aspect

In a sixteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 96 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 96.

In one embodiment, the polypeptide preferably comprises or consists of the amino acid sequence of SEQ ID NO: 96 or an allelic variant thereof; comprises the amino acid sequence of SEQ ID NO: 96 and a N-terminal and/or C-terminal His-tag and/or HQ-tag such as SEQ ID NO: 100 or the mature polypeptide of SEQ ID NO: 99; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 96. In another embodiment, the polypeptide comprises or consists of amino acids 1 to 536 of SEQ ID NO: 96. In another embodiment, the polypeptide comprises or consists of the mature polypeptide of SEQ ID NO: 99. In another embodiment, the polypeptide comprises or consists of amino acids 1 to 566 of SEQ ID NO: 99. In an embodiment, the polypeptide has been isolated.

In a continuation of the sixteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 97 of at least 80%. In an embodiment, the GH5 polypeptide has a sequence identity to SEQ ID NO: 97 of at least 85%. In an embodiment, the GH5 polypeptide has a sequence identity to SEQ ID NO: 97 of at least 86%. In an embodiment, the GH5 polypeptide has a sequence identity to SEQ ID NO: 97 of at least 87%. In an embodiment, the GH5 polypeptide has a sequence identity to SEQ ID NO: 97 of at least 88%. In an embodiment, the GH5 polypeptide has a sequence identity to SEQ ID NO: 97 of at least 89%. In an embodiment, the GH5 polypeptide has a sequence identity to SEQ ID NO: 97 of at least 90%. In an embodiment, the GH5 polypeptide has a sequence identity to SEQ ID NO: 97 of at least 91%. In an embodiment, the GH5 polypeptide has a sequence identity to SEQ ID NO: 97 of at least 92%. In an embodiment, the GH5 polypeptide has a sequence identity to SEQ ID NO: 97 of at least 93%. In an embodiment, the GH5 polypeptide has a sequence identity to SEQ ID NO: 97 of at least 94%. In an embodiment, the GH5 polypeptide has a sequence identity to SEQ ID NO: 97 of at least 95%. In an embodiment, the GH5 polypeptide has a sequence identity to SEQ ID NO: 97 of at least 96%. In an embodiment, the GH5 polypeptide has a sequence identity to SEQ ID NO: 97 of at least 97%. In an embodiment, the GH5 polypeptide has a sequence identity to SEQ ID NO: 97 of at least 98%. In an embodiment, the GH5 polypeptide has a sequence identity to SEQ ID NO: 97 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 97. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 100.

In one embodiment, the polypeptide preferably comprises or consists of the amino acid sequence of SEQ ID NO: 97 or an allelic variant thereof; comprises the amino acid sequence of SEQ ID NO: 97 and a N-terminal and/or C-terminal His-tag and/or HQ-tag such as SEQ ID NO: 100; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 97. In another embodiment, the polypeptide comprises or consists of amino acids 1 to 544 of SEQ ID NO: 100. In an embodiment, the polypeptide has been isolated.

In a continuation of the sixteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 95, (ii) the mature polypeptide coding sequence of SEQ ID NO: 98, or (iii) the full-length complement of (i) or (ii) (Sambrook et al., supra). In an embodiment, the polypeptide has been isolated.

In a continuation of the sixteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 95 or SEQ ID NO: 98 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the sixteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 97 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 97 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 97 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 97 is not more than 10, e.g., 1, 2, 3, 4, 5, 6, 7, 8, 9 or 10. In another embodiment, the number of substitutions and/or deletions and/or insertions in SEQ ID NO: 97 is not more than 10, e.g., 1, 2, 3, 4, 5, 6, 7, 8, 9 or 10. In a further embodiment, the number of substitutions in SEQ ID NO: 97 is not more than 10, e.g., 1, 2, 3, 4, 5, 6, 7, 8, 9 or 10. In a further embodiment, the number of conservative substitutions in SEQ ID NO: 97 is not more than 10, e.g., 1, 2, 3, 4, 5, 6, 7, 8, 9 or 10. Examples of amino acid changes, conservative substitutions and fusion peptides are described in the fourth aspect of the invention.

Seventeenth Aspect

In a seventeenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 102 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 102.

In one embodiment, the polypeptide preferably comprises or consists of the amino acid sequence of SEQ ID NO: 102 or an allelic variant thereof; comprises the amino acid sequence of SEQ ID NO: 102 and a N-terminal and/or C-terminal His-tag and/or HQ-tag such as SEQ ID NO: 106 or the mature polypeptide of SEQ ID NO: 105; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 102. In another embodiment, the polypeptide comprises or consists of amino acids 1 to 536 of SEQ ID NO: 102. In another embodiment, the polypeptide comprises or consists of the mature polypeptide of SEQ ID NO: 105. In another embodiment, the polypeptide comprises or consists of amino acids 1 to 544 of SEQ ID NO: 105. In an embodiment, the polypeptide has been isolated.

In a continuation of the seventeenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 103 of at least 80%. In an embodiment, the GH5 polypeptide has a sequence identity to SEQ ID NO: 103 of at least 85%. In an embodiment, the GH5 polypeptide has a sequence identity to SEQ ID NO: 103 of at least 86%. In an embodiment, the GH5 polypeptide has a sequence identity to SEQ ID NO: 103 of at least 87%. In an embodiment, the GH5 polypeptide has a sequence identity to SEQ ID NO: 103 of at least 88%. In an embodiment, the GH5 polypeptide has a sequence identity to SEQ ID NO: 103 of at least 89%. In an embodiment, the GH5 polypeptide has a sequence identity to SEQ ID NO: 103 of at least 90%. In an embodiment, the GH5 polypeptide has a sequence identity to SEQ ID NO: 103 of at least 91%. In an embodiment, the GH5 polypeptide has a sequence identity to SEQ ID NO: 103 of at least 92%. In an embodiment, the GH5 polypeptide has a sequence identity to SEQ ID NO: 103 of at least 93%. In an embodiment, the GH5 polypeptide has a sequence identity to SEQ ID NO: 103 of at least 94%. In an embodiment, the GH5 polypeptide has a sequence identity to SEQ ID NO: 103 of at least 95%. In an embodiment, the GH5 polypeptide has a sequence identity to SEQ ID NO: 103 of at least 96%. In an embodiment, the GH5 polypeptide has a sequence identity to SEQ ID NO: 103 of at least 97%. In an embodiment, the GH5 polypeptide has a sequence identity to SEQ ID NO: 103 of at least 98%. In an embodiment, the GH5 polypeptide has a sequence identity to SEQ ID NO: 103 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 103. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 106.

In one embodiment, the polypeptide preferably comprises or consists of the amino acid sequence of SEQ ID NO: 103 or an allelic variant thereof; comprises the amino acid sequence of SEQ ID NO: 103 and a N-terminal and/or C-terminal His-tag and/or HQ-tag such as SEQ ID NO: 106; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 103. In another embodiment, the polypeptide comprises or consists of amino acids 1 to 544 of SEQ ID NO: 106. In an embodiment, the polypeptide has been isolated.

In a continuation of the seventeenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 101, (ii) the mature polypeptide coding sequence of SEQ ID NO: 104, or (iii) the full-length complement of (i) or (ii) (Sambrook et al., supra). In an embodiment, the polypeptide has been isolated.

In a continuation of the seventeenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 101 or SEQ ID NO: 104 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the seventeenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 103 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 103 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 103 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 103 is not more than 10, e.g., 1, 2, 3, 4, 5, 6, 7, 8, 9 or 10. In another embodiment, the number of substitutions and/or deletions and/or insertions in SEQ ID NO: 103 is not more than 10, e.g., 1, 2, 3, 4, 5, 6, 7, 8, 9 or 10. In a further embodiment, the number of substitutions in SEQ ID NO: 103 is not more than 10, e.g., 1, 2, 3, 4, 5, 6, 7, 8, 9 or 10. In a further embodiment, the number of conservative substitutions in SEQ ID NO: 103 is not more than 10, e.g., 1, 2, 3, 4, 5, 6, 7, 8, 9 or 10. Examples of amino acid changes, conservative substitutions and fusion peptides are described in the fourth aspect of the invention.

Eighteenth Aspect

In an eighteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 108 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 108.

In one embodiment, the polypeptide preferably comprises or consists of the amino acid sequence of SEQ ID NO: 108 or an allelic variant thereof; comprises the amino acid sequence of SEQ ID NO: 108 and a N-terminal and/or C-terminal His-tag and/or HQ-tag such as SEQ ID NO: 112 or the mature polypeptide of SEQ ID NO: 111; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 108. In another embodiment, the polypeptide comprises or consists of amino acids 1 to 536 of SEQ ID NO: 108. In another embodiment, the polypeptide comprises or consists of the mature polypeptide of SEQ ID NO: 111. In another embodiment, the polypeptide comprises or consists of amino acids 1 to 544 of SEQ ID NO: 111. In an embodiment, the polypeptide has been isolated.

In a continuation of the eighteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 109 of at least 80%. In an embodiment, the GH5 polypeptide has a sequence identity to SEQ ID NO: 109 of at least 85%. In an embodiment, the GH5 polypeptide has a sequence identity to SEQ ID NO: 109 of at least 86%. In an embodiment, the GH5 polypeptide has a sequence identity to SEQ ID NO: 109 of at least 87%. In an embodiment, the GH5 polypeptide has a sequence identity to SEQ ID NO: 109 of at least 88%. In an embodiment, the GH5 polypeptide has a sequence identity to SEQ ID NO: 109 of at least 89%. In an embodiment, the GH5 polypeptide has a sequence identity to SEQ ID NO: 109 of at least 90%. In an embodiment, the GH5 polypeptide has a sequence identity to SEQ ID NO: 109 of at least 91%. In an embodiment, the GH5 polypeptide has a sequence identity to SEQ ID NO: 109 of at least 92%. In an embodiment, the GH5 polypeptide has a sequence identity to SEQ ID NO: 109 of at least 93%. In an embodiment, the GH5 polypeptide has a sequence identity to SEQ ID NO: 109 of at least 94%. In an embodiment, the GH5 polypeptide has a sequence identity to SEQ ID NO: 109 of at least 95%. In an embodiment, the GH5 polypeptide has a sequence identity to SEQ ID NO: 109 of at least 96%. In an embodiment, the GH5 polypeptide has a sequence identity to SEQ ID NO: 109 of at least 97%. In an embodiment, the GH5 polypeptide has a sequence identity to SEQ ID NO: 109 of at least 98%. In an embodiment, the GH5 polypeptide has a sequence identity to SEQ ID NO: 109 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 109. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 112.

In one embodiment, the polypeptide preferably comprises or consists of the amino acid sequence of SEQ ID NO: 109 or an allelic variant thereof; comprises the amino acid sequence of SEQ ID NO: 109 and a N-terminal and/or C-terminal His-tag and/or HQ-tag such as SEQ ID NO: 112; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 109. In another embodiment, the polypeptide comprises or consists of amino acids 1 to 544 of SEQ ID NO: 112. In an embodiment, the polypeptide has been isolated.

In a continuation of the eighteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 107, (ii) the mature polypeptide coding sequence of SEQ ID NO: 110, or (iii) the full-length complement of (i) or (ii) (Sambrook et al., supra). In an embodiment, the polypeptide has been isolated.

In a continuation of the eighteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 107 or SEQ ID NO: 110 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the eighteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 109 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 109 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 109 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 109 is not more than 10, e.g., 1, 2, 3, 4, 5, 6, 7, 8, 9 or 10. In another embodiment, the number of substitutions and/or deletions and/or insertions in SEQ ID NO: 109 is not more than 10, e.g., 1, 2, 3, 4, 5, 6, 7, 8, 9 or 10. In a further embodiment, the number of substitutions in SEQ ID NO: 109 is not more than 10, e.g., 1, 2, 3, 4, 5, 6, 7, 8, 9 or 10. In a further embodiment, the number of conservative substitutions in SEQ ID NO: 109 is not more than 10, e.g., 1, 2, 3, 4, 5, 6, 7, 8, 9 or 10. Examples of amino acid changes, conservative substitutions and fusion peptides are described in the fourth aspect of the invention.

Nineteenth Aspect

In a nineteenth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 114 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 114.

In one embodiment, the polypeptide preferably comprises or consists of the amino acid sequence of SEQ ID NO: 114 or an allelic variant thereof; comprises the amino acid sequence of SEQ ID NO: 114 and a N-terminal and/or C-terminal His-tag and/or HQ-tag such as SEQ ID NO: 118 or the mature polypeptide of SEQ ID NO: 117; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 114. In another embodiment, the polypeptide comprises or consists of amino acids 1 to 538 of SEQ ID NO: 114. In another embodiment, the polypeptide comprises or consists of the mature polypeptide of SEQ ID NO: 117. In another embodiment, the polypeptide comprises or consists of amino acids 1 to 546 of SEQ ID NO: 117. In an embodiment, the polypeptide has been isolated.

In a continuation of the nineteenth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 115 of at least 80%. In an embodiment, the GH5 polypeptide has a sequence identity to SEQ ID NO: 115 of at least 85%. In an embodiment, the GH5 polypeptide has a sequence identity to SEQ ID NO: 115 of at least 86%. In an embodiment, the GH5 polypeptide has a sequence identity to SEQ ID NO: 115 of at least 87%. In an embodiment, the GH5 polypeptide has a sequence identity to SEQ ID NO: 115 of at least 88%. In an embodiment, the GH5 polypeptide has a sequence identity to SEQ ID NO: 115 of at least 89%. In an embodiment, the GH5 polypeptide has a sequence identity to SEQ ID NO: 115 of at least 90%. In an embodiment, the GH5 polypeptide has a sequence identity to SEQ ID NO: 115 of at least 91%. In an embodiment, the GH5 polypeptide has a sequence identity to SEQ ID NO: 115 of at least 92%. In an embodiment, the GH5 polypeptide has a sequence identity to SEQ ID NO: 115 of at least 93%. In an embodiment, the GH5 polypeptide has a sequence identity to SEQ ID NO: 115 of at least 94%. In an embodiment, the GH5 polypeptide has a sequence identity to SEQ ID NO: 115 of at least 95%. In an embodiment, the GH5 polypeptide has a sequence identity to SEQ ID NO: 115 of at least 96%. In an embodiment, the GH5 polypeptide has a sequence identity to SEQ ID NO: 115 of at least 97%. In an embodiment, the GH5 polypeptide has a sequence identity to SEQ ID NO: 115 of at least 98%. In an embodiment, the GH5 polypeptide has a sequence identity to SEQ ID NO: 115 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 115. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 118.

In one embodiment, the polypeptide preferably comprises or consists of the amino acid sequence of SEQ ID NO: 115 or an allelic variant thereof; comprises the amino acid sequence of SEQ ID NO: 115 and a N-terminal and/or C-terminal His-tag and/or HQ-tag such as SEQ ID NO: 118; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 538 of SEQ ID NO: 115. In another embodiment, the polypeptide comprises or consists of amino acids 1 to 546 of SEQ ID NO: 118. In an embodiment, the polypeptide has been isolated.

In a continuation of the nineteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 113, (ii) the mature polypeptide coding sequence of SEQ ID NO: 116, or (iii) the full-length complement of (i) or (ii) (Sambrook et al., supra). In an embodiment, the polypeptide has been isolated.

In a continuation of the nineteenth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 113 or SEQ ID NO: 116 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the nineteenth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 115 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 115 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 115 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 115 is not more than 10, e.g., 1, 2, 3, 4, 5, 6, 7, 8, 9 or 10. In another embodiment, the number of substitutions and/or deletions and/or insertions in SEQ ID NO: 115 is not more than 10, e.g., 1, 2, 3, 4, 5, 6, 7, 8, 9 or 10. In a further embodiment, the number of substitutions in SEQ ID NO: 115 is not more than 10, e.g., 1, 2, 3, 4, 5, 6, 7, 8, 9 or 10. In a further embodiment, the number of conservative substitutions in SEQ ID NO: 115 is not more than 10, e.g., 1, 2, 3, 4, 5, 6, 7, 8, 9 or 10. Examples of amino acid changes, conservative substitutions and fusion peptides are described in the fourth aspect of the invention.

Twentieth Aspect

In a twentieth aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 120 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 120.

In one embodiment, the polypeptide preferably comprises or consists of the amino acid sequence of SEQ ID NO: 120 or an allelic variant thereof; comprises the amino acid sequence of SEQ ID NO: 120 and a N-terminal and/or C-terminal His-tag and/or HQ-tag such as SEQ ID NO: 124 or the mature polypeptide of SEQ ID NO: 123; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 120. In another embodiment, the polypeptide comprises or consists of amino acids 1 to 537 of SEQ ID NO: 120. In another embodiment, the polypeptide comprises or consists of the mature polypeptide of SEQ ID NO: 123. In another embodiment, the polypeptide comprises or consists of amino acids 1 to 545 of SEQ ID NO: 123. In an embodiment, the polypeptide has been isolated.

In a continuation of the twentieth aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 121 of at least 80%. In an embodiment, the GH5 polypeptide has a sequence identity to SEQ ID NO: 121 of at least 85%. In an embodiment, the GH5 polypeptide has a sequence identity to SEQ ID NO: 121 of at least 86%. In an embodiment, the GH5 polypeptide has a sequence identity to SEQ ID NO: 121 of at least 87%. In an embodiment, the GH5 polypeptide has a sequence identity to SEQ ID NO: 121 of at least 88%. In an embodiment, the GH5 polypeptide has a sequence identity to SEQ ID NO: 121 of at least 89%. In an embodiment, the GH5 polypeptide has a sequence identity to SEQ ID NO: 121 of at least 90%. In an embodiment, the GH5 polypeptide has a sequence identity to SEQ ID NO: 121 of at least 91%. In an embodiment, the GH5 polypeptide has a sequence identity to SEQ ID NO: 121 of at least 92%. In an embodiment, the GH5 polypeptide has a sequence identity to SEQ ID NO: 121 of at least 93%. In an embodiment, the GH5 polypeptide has a sequence identity to SEQ ID NO: 121 of at least 94%. In an embodiment, the GH5 polypeptide has a sequence identity to SEQ ID NO: 121 of at least 95%. In an embodiment, the GH5 polypeptide has a sequence identity to SEQ ID NO: 121 of at least 96%. In an embodiment, the GH5 polypeptide has a sequence identity to SEQ ID NO: 121 of at least 97%. In an embodiment, the GH5 polypeptide has a sequence identity to SEQ ID NO: 121 of at least 98%. In an embodiment, the GH5 polypeptide has a sequence identity to SEQ ID NO: 121 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 121. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 124.

In one embodiment, the polypeptide preferably comprises or consists of the amino acid sequence of SEQ ID NO: 121 or an allelic variant thereof; comprises the amino acid sequence of SEQ ID NO: 121 and a N-terminal and/or C-terminal His-tag and/or HQ-tag such as SEQ ID NO: 124;

or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 121. In another embodiment, the polypeptide comprises or consists of amino acids 1 to 545 of SEQ ID NO: 124. In an embodiment, the polypeptide has been isolated.

In a continuation of the twentieth aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 119, (ii) the mature polypeptide coding sequence of SEQ ID NO: 122, or (iii) the full-length complement of (i) or (ii) (Sambrook et al., supra). In an embodiment, the polypeptide has been isolated.

In a continuation of the twentieth aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 119 or SEQ ID NO: 122 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twentieth aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 121 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 121 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 121 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 121 is not more than 10, e.g., 1, 2, 3, 4, 5, 6, 7, 8, 9 or 10. In another embodiment, the number of substitutions and/or deletions and/or insertions in SEQ ID NO: 121 is not more than 10, e.g., 1, 2, 3, 4, 5, 6, 7, 8, 9 or 10. In a further embodiment, the number of substitutions in SEQ ID NO: 121 is not more than 10, e.g., 1, 2, 3, 4, 5, 6, 7, 8, 9 or 10. In a further embodiment, the number of conservative substitutions in SEQ ID NO: 121 is not more than 10, e.g., 1, 2, 3, 4, 5, 6, 7, 8, 9 or 10. Examples of amino acid changes, conservative substitutions and fusion peptides are described in the fourth aspect of the invention.

Twenty-First Aspect

In a twenty-first aspect, the invention relates to a method of releasing xylose from plant based material, comprising treating plant based material from the sub-family Panicoideae with a composition comprising a formulating agent and a GH5 polypeptide having xylanase activity, wherein the GH5 polypeptide having xylanase activity has a sequence identity to the mature polypeptide of SEQ ID NO: 126 of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 126.

In one embodiment, the polypeptide preferably comprises or consists of the amino acid sequence of SEQ ID NO: 126 or an allelic variant thereof; comprises the amino acid sequence of SEQ ID NO: 126 and a N-terminal and/or C-terminal His-tag and/or HQ-tag such as SEQ ID NO: 130 or the mature polypeptide of SEQ ID NO: 129; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 126. In another embodiment, the polypeptide comprises or consists of amino acids 1 to 536 of SEQ ID NO: 126. In another embodiment, the polypeptide comprises or consists of the mature polypeptide of SEQ ID NO: 129. In another embodiment, the polypeptide comprises or consists of amino acids 1 to 544 of SEQ ID NO: 129. In an embodiment, the polypeptide has been isolated.

In a continuation of the twenty-first aspect, the invention relates to a method of releasing xylose from plant based material, comprising treating plant based material from the sub-family Panicoideae with a composition comprising a formulating agent and a GH5 polypeptide having xylanase activity having a sequence identity to SEQ ID NO: 127 of at least 80%. In an embodiment, the GH5 polypeptide has a sequence identity to SEQ ID NO: 127 of at least 85%. In an embodiment, the GH5 polypeptide has a sequence identity to SEQ ID NO: 127 of at least 86%. In an embodiment, the GH5 polypeptide has a sequence identity to SEQ ID NO: 127 of at least 87%. In an embodiment, the GH5 polypeptide has a sequence identity to SEQ ID NO: 127 of at least 88%. In an embodiment, the GH5 polypeptide has a sequence identity to SEQ ID NO: 127 of at least 89%. In an embodiment, the GH5 polypeptide has a sequence identity to SEQ ID NO: 127 of at least 90%. In an embodiment, the GH5 polypeptide has a sequence identity to SEQ ID NO: 127 of at least 91%. In an embodiment, the GH5 polypeptide has a sequence identity to SEQ ID NO: 127 of at least 92%. In an embodiment, the GH5 polypeptide has a sequence identity to SEQ ID NO: 127 of at least 93%. In an embodiment, the GH5 polypeptide has a sequence identity to SEQ ID NO:

127 of at least 94%. In an embodiment, the GH5 polypeptide has a sequence identity to SEQ ID NO: 127 of at least 95%. In an embodiment, the GH5 polypeptide has a sequence identity to SEQ ID NO: 127 of at least 96%. In an embodiment, the GH5 polypeptide has a sequence identity to SEQ ID NO: 127 of at least 97%. In an embodiment, the GH5 polypeptide has a sequence identity to SEQ ID NO: 127 of at least 98%. In an embodiment, the GH5 polypeptide has a sequence identity to SEQ ID NO: 127 of at least 99%.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 127. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 to SEQ ID NO: 130.

In one embodiment, the polypeptide preferably comprises or consists of the amino acid sequence of SEQ ID NO: 127 or an allelic variant thereof; comprises the amino acid sequence of SEQ ID NO: 127 and a N-terminal and/or C-terminal His-tag and/or HQ-tag such as SEQ ID NO: 130; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 127. In another embodiment, the polypeptide comprises or consists of amino acids 1 to 544 of SEQ ID NO: 130. In an embodiment, the polypeptide has been isolated.

In a continuation of the twenty-first aspect, the invention relates to a method of releasing xylose from plant based material, comprising treating plant based material from the sub-family Panicoideae with a composition comprising a formulating agent and a GH5 polypeptide having xylanase activity encoded by a polynucleotide that hybridizes under medium-high stringency conditions, high stringency conditions, or very high stringency conditions with (i) the mature polypeptide coding sequence of SEQ ID NO: 125, (ii) the mature polypeptide coding sequence of SEQ ID NO: 128, or (iii) the full-length complement of (i) or (ii) (Sambrook et al., supra). In an embodiment, the polypeptide has been isolated.

In a continuation of the twenty-first aspect, the invention relates to a method of releasing xylose from plant based material, comprising treating plant based material from the sub-family Panicoideae with a composition comprising a formulating agent and a GH5 polypeptide having xylanase activity encoded by a polynucleotide having a sequence identity to the mature polypeptide coding sequence of SEQ ID NO: 125 or SEQ ID NO: 128 or the cDNA sequence thereof of at least 80%, e.g., at least 85%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-first aspect, the invention relates to a method of releasing xylose from plant based material, comprising treating plant based material from the sub-family Panicoideae with a composition comprising a formulating agent and a GH5 polypeptide having xylanase activity, wherein the peptide having xylanase activity is a variant of SEQ ID NO: 127 comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 127 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 127 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 127 is not more than 10, e.g., 1, 2, 3, 4, 5, 6, 7, 8, 9 or 10. In another embodiment, the number of substitutions and/or deletions and/or insertions in SEQ ID NO: 127 is not more than 10, e.g., 1, 2, 3, 4, 5, 6, 7, 8, 9 or 10. In a further embodiment, the number of substitutions in SEQ ID NO: 127 is not more than 10, e.g., 1, 2, 3, 4, 5, 6, 7, 8, 9 or 10. In a further embodiment, the number of conservative substitutions in SEQ ID NO: 127 is not more than 10, e.g., 1, 2, 3, 4, 5, 6, 7, 8, 9 or 10. Examples of amino acid changes, conservative substitutions and fusion peptides are described in the fourth aspect of the invention.

Polypeptides Having Multiple Motif's

In an embodiment, the GH5 polypeptide comprises one or more motif I (as described in the first aspect) and one or more motif II (as described in the second aspect). In an embodiment, the GH5 polypeptide comprises one or more motif I (as described in the first aspect) and one or more motif III (as described in the third aspect). In an embodiment, the GH5 polypeptide comprises one or more motif II (as described in the second aspect) and one or more motif III (as described in the third aspect). In a further embodiment, the GH5 is the polypeptide of one or more, such as all, of aspects four, five, six, seven, nine, ten, eleven, twelve, thirteen, fourteen, fifteen, sixteen, seventeen, eighteen, nineteen, twenty and twenty-one of the invention.

In an embodiment, the GH5 polypeptide comprises one or more motif I (as described in the first aspect), one or more motif II (as described in the second aspect) and/or one or more motif III (as described in the third aspect). In a preferred embodiment, the GH5 polypeptide having xylanase activity and comprising one or more motif I (as described in the first aspect), one or more motif II (as described in the second aspect) and/or one or more motif III (as described in the third aspect) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In a further embodiment, the GH5 is the polypeptide of one or more, such as all, of aspects four, five, six, seven, nine, ten, eleven, twelve, thirteen, fourteen, fifteen, sixteen, seventeen, eighteen, nineteen, twenty and twenty-one of the invention, more preferably one or more, such as all, of aspects four, six, seven, nine, ten, twelve, thirteen, fourteen, fifteen, sixteen, seventeen, eighteen, twenty and twenty-one of the invention, even more preferably one or more, such as all, of aspects seven, nine, ten, twelve, fifteen, sixteen, seventeen, eighteen and twenty-one of the invention.

In a preferred embodiment, the GH5 is the polypeptide comprising one or more motif I (as described in the first aspect), one or more motif II (as described in the second aspect) and/or one or more motif III (as described in the third aspect) is of one or more, such as all, of aspects four, six, seven, nine, ten, twelve, thirteen, fourteen, fifteen, sixteen, seventeen, eighteen, twenty and twenty-one of the invention and the percentage solubilised xylose is at least at least 6%, such as at least 6.5%, at least 7.0%, at least 7.5% or at least 8% when the method is performed under the reaction conditions 10 mg GH5 polypeptide per kg DFDSM and incubation at 40° C., pH 5 for 4 hours. In an even more preferred embodiment, the GH5 is the polypeptide of one or more, such as all, of aspects seven, nine, ten, twelve, fifteen, sixteen, seventeen, eighteen and twenty-one of the invention and the percentage solubilised xylose is at least at least 7%, such as at least 7.5% or at least 8% when the method is performed under the reaction conditions 10 mg GH5 polypeptide per kg DFDSM and incubation at 40° C., pH 5 for 4 hours.

In a more preferred embodiment, the GH5 polypeptide having xylanase activity and comprising one or more motif I (as described in the first aspect), one or more motif II (as described in the second aspect) and one or more motif III (as described in the third aspect) releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In a further embodiment, the GH5 is the polypeptide of one or more, such as all, of aspects four, five, six, seven, nine, ten, eleven, twelve, thirteen, fourteen, fifteen, sixteen, seventeen, eighteen, nineteen, twenty and twenty-one of the invention, more preferably one or more, such as all, of aspects four, six, seven, nine, ten, twelve, thirteen, fourteen, fifteen, sixteen, seventeen, eighteen, twenty and twenty-one of the invention, even more preferably one or more, such as all, of aspects seven, nine, ten, twelve, fifteen, sixteen, seventeen, eighteen and twenty-one of the invention.

In a preferred embodiment, the GH5 is the polypeptide comprising one or more motif I (as described in the first aspect), one or more motif II (as described in the second aspect) and one or more motif III (as described in the third aspect) is of one or more, such as all, of aspects four, six, seven, nine, ten, twelve, thirteen, fourteen, fifteen, sixteen, seventeen, eighteen, twenty and twenty-one of the invention and the percentage solubilised xylose is at least at least 6%, such as at least 6.5%, at least 7.0%, at least 7.5% or at least 8% when the method is performed under the reaction conditions 10 mg GH5 polypeptide per kg DFDSM and incubation at 40° C., pH 5 for 4 hours. In an even more preferred embodiment, the GH5 is the polypeptide of one or more, such as all, of aspects seven, nine, ten, twelve, fifteen, sixteen, seventeen, eighteen and twenty-one of the invention and the percentage solubilised xylose is at least at least 7%, such as at least 7.5% or at least 8% when the method is performed under the reaction conditions 10 mg GH5 polypeptide per kg DFDSM and incubation at 40° C., pH 5 for 4 hours.

In an embodiment, the GH5 polypeptide having xylanase activity and comprising one or more motif I (as described in the first aspect), and/or one or more motif II (as described in the second aspect) and/or one or more motif III (as described in the third aspect) releases at least 2.5% more solubilized xylose from plant based material from the sub-family Panicoideae compared to Ronozyme WX (a GH11 xylanase, SEQ ID NO: 51). In an embodiment, the percentage solubilised xylose is at least 3.0%, such as at least 3.5%, at least 4.0%, at least 4.5%, at least 5%, at least 5.5%, at least 6%, at least 6.5%, at least 7%, at least 7.5% or at least 8% higher compared to Ronozyme WX. In a further embodiment, the GH5 is the polypeptide of one or more, such as all, of aspects four, five, six, seven, nine, ten, eleven, twelve, thirteen, fourteen, fifteen, sixteen, seventeen, eighteen, nineteen, twenty and twenty-one of the invention, more preferably one or more, such as all, of aspects seven, nine, ten, twelve, fifteen, sixteen, seventeen, eighteen and twenty-one of the invention.

In an embodiment, the GH5 polypeptide having xylanase activity and comprising one or more motif I (as described in the first aspect), one or more motif II (as described in the second aspect) and one or more motif III (as described in the third aspect) releases at least 2.5% more solubilized xylose from plant based material from the sub-family Panicoideae compared to Ronozyme WX (a GH11 xylanase, SEQ ID NO: 51). In an embodiment, the percentage solubilised xylose is at least 3.0%, such as at least 3.5%, at least 4.0%, at least 4.5%, at least 5%, at least 5.5%, at least 6%, at least 6.5%, at least 7%, at least 7.5% or at least 8% higher compared to Ronozyme WX. In a further embodiment, the GH5 is the polypeptide of one or more, such as all, of aspects four, five, six, seven, nine, ten, eleven, twelve, thirteen, fourteen, fifteen, sixteen, seventeen, eighteen, nineteen, twenty and twenty-one of the invention, more preferably one or more of aspects seven, nine, ten, twelve, fifteen, sixteen, seventeen, eighteen and twenty-one of the invention, even more preferably all of aspects seven, nine, ten, twelve, fifteen, sixteen, seventeen, eighteen and twenty-one of the invention.

Polypeptides Having Xylanase Activity
Twenty-Second Aspect

In a twenty-second aspect, the invention relates to polypeptides having a sequence identity to the mature polypeptide of SEQ ID NO: 2 of at least 99.3%, e.g., at least 99.4%, at least 99.5%, at least 99.6%, at least 99.7%, at least 99.8%, at least 99.9% or 100%, which have xylanase activity. In one embodiment, the polypeptides differ by up to 4 amino acids, e.g., 1, 2, 3 or 4 amino acids from the mature polypeptide of SEQ ID NO: 2.

In one embodiment, the polypeptide preferably comprises or consists of the amino acid sequence of SEQ ID NO: 2 or an allelic variant thereof; comprises the amino acid sequence of SEQ ID NO: 2 and a N-terminal and/or C-terminal His-tag and/or HQ-tag such as SEQ ID NO: 6 or the mature polypeptide of SEQ ID NO: 5; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 2. In another embodiment, the polypeptide comprises or consists of amino acids 1 to 537 of SEQ ID NO: 2. In another embodiment, the polypeptide comprises or consists of the mature polypeptide of SEQ ID NO: 5. In another embodiment, the polypeptide comprises or consists of amino acids 1 to 546 of SEQ ID NO: 5. In an embodiment, the polypeptide has been isolated.

In a continuation of the twenty-second aspect, the invention further relates to polypeptides having a sequence identity to SEQ ID NO: 3 of at least 99.3% which have xylanase activity. In an embodiment, the GH5 polypeptide has a sequence identity to SEQ ID NO: 3 of at least 99.4%. In an embodiment, the GH5 polypeptide has a sequence identity to SEQ ID NO: 3 of at least 99.5%. In an embodiment, the GH5 polypeptide has a sequence identity to SEQ ID NO: 3 of at least 99.6%. In an embodiment, the GH5 polypeptide has a sequence identity to SEQ ID NO: 3 of at least 99.7%. In an embodiment, the GH5 polypeptide has a sequence identity to SEQ ID NO: 3 of at least 99.8%. In an embodiment, the GH5 polypeptide has a sequence identity to SEQ ID NO: 3 of at least 99.9%. The polypeptides of the twenty-second aspect have at least 75%, preferably at least 90%, more preferably at least 95%, and most preferably at least 100% of the xylanase activity of SEQ ID NO: 3.

In one embodiment, the polypeptides differ by up to 4 amino acids, e.g., 1, 2, 3 or 4 amino acids from SEQ ID NO: 3. In one embodiment, the polypeptides differ by up to 4 amino acids, e.g., 1, 2, 3 or 4 amino acids from SEQ ID NO: 6.

In one embodiment, the polypeptide preferably comprises or consists of the amino acid sequence of SEQ ID NO: 3 or an allelic variant thereof; comprises the amino acid sequence of SEQ ID NO: 3 and a N-terminal and/or C-terminal His-tag and/or HQ-tag such as SEQ ID NO: 6; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 3. In another embodiment, the polypeptide comprises or consists of amino acids 1 to 546 of SEQ ID NO: 6. In an embodiment, the polypeptide has been isolated.

In a continuation of the twenty-second aspect, the invention relates to a GH5 polypeptide having xylanase activity encoded by a polynucleotide that hybridizes under very high stringency conditions with (i) the mature polypeptide coding sequence of SEQ ID NO: 1, (ii) the mature polypeptide coding sequence of SEQ ID NO: 4, or (iii) the full-length complement of (i) or (ii) (Sambrook et al., supra). In an embodiment, the polypeptide has been isolated.

In a continuation of the twenty-second aspect, the invention relates to a GH5 polypeptide having xylanase activity encoded by a polynucleotide having a sequence identity to the mature polypeptide coding sequence of SEQ ID NO: 1 or SEQ ID NO: 4 or the cDNA sequence thereof of at least 99.3%, e.g., at least 99.4%, at least 99.5%, at least 99.6%, at least 99.7%, at least 99.8%, at least 99.9% or 100%. In a further embodiment, the polypeptide has been isolated.

In a continuation of the twenty-second aspect, the invention relates to variants of SEQ ID NO: 3 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 3 is not more than 4, e.g., 1, 2, 3 or 4. In another embodiment, the number of substitutions and/or deletions and/or insertions in SEQ ID NO: 3 is not more than 4, e.g., 1, 2, 3 or 4. In a further embodiment, the number of substitutions in SEQ ID NO: 3 is not more than 4, e.g., 1, 2, 3 or 4. In a further embodiment, the number of conservative substitutions in SEQ ID NO: 3 is not more than 4, e.g., 1, 2, 3 or 4. Examples of amino acid changes, conservative substitutions and fusion peptides are described in the fourth aspect of the invention.

Twenty-Third Aspect

In a twenty-third aspect, the invention relates to polypeptides having a sequence identity to the mature polypeptide of SEQ ID NO: 8 at least 83%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 8.

In one embodiment, the polypeptide preferably comprises or consists of the amino acid sequence of SEQ ID NO: 8 or an allelic variant thereof; comprises the amino acid sequence of SEQ ID NO: 8 and a N-terminal and/or C-terminal His-tag and/or HQ-tag such as SEQ ID NO: 12 or the mature polypeptide of SEQ ID NO: 11; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 8. In another embodiment, the polypeptide comprises or consists of amino acids 1 to 547 of SEQ ID NO: 8. In another embodiment, the polypeptide comprises or consists of the mature polypeptide of SEQ ID NO: 11. In another embodiment, the polypeptide comprises or consists of amino acids 1 to 555 of SEQ ID NO: 11. In an embodiment, the polypeptide has been isolated.

In a continuation of the twenty-third aspect, the invention relates to polypeptides having a sequence identity to SEQ ID NO: 9 of at least 83% which have xylanase activity. In an embodiment, the GH5 polypeptide has a sequence identity to SEQ ID NO: 9 of at least 85%. In an embodiment, the GH5 polypeptide has a sequence identity to SEQ ID NO: 9 of at least 86%. In an embodiment, the GH5 polypeptide has a sequence identity to SEQ ID NO: 9 of at least 87%. In an embodiment, the GH5 polypeptide has a sequence identity to SEQ ID NO: 9 of at least 88%. In an embodiment, the GH5 polypeptide has a sequence identity to SEQ ID NO: 9 of at least 89%. In an embodiment, the GH5 polypeptide has a sequence identity to SEQ ID NO: 9 of at least 90%. In an embodiment, the GH5 polypeptide has a sequence identity to SEQ ID NO: 9 of at least 91%. In an embodiment, the GH5 polypeptide has a sequence identity to SEQ ID NO: 9 of at least 92%. In an embodiment, the GH5 polypeptide has a sequence identity to SEQ ID NO: 9 of at least 93%. In an embodiment, the GH5 polypeptide has a sequence identity to SEQ ID NO: 9 of at least 94%. In an embodiment, the GH5 polypeptide has a sequence identity to SEQ ID NO: 9 of at least 95%. In an embodiment, the GH5 polypeptide has a sequence identity to SEQ ID NO: 9 of at least 96%. In an embodiment, the GH5 polypeptide has a sequence identity to SEQ ID NO: 9 of at least 97%. In an embodiment, the GH5 polypeptide has a sequence identity to SEQ ID NO: 9 of at least 98%. In an embodiment, the GH5 polypeptide has a sequence identity to SEQ ID NO: 9 of at least 99%. The polypeptides of the twenty-third aspect have at least 75%, preferably at least 90%, more preferably at least 95%, and most preferably at least 100% of the xylanase activity of SEQ ID NO: 9.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 9. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 12.

In one embodiment, the polypeptide preferably comprises or consists of the amino acid sequence of SEQ ID NO: 9 or an allelic variant thereof; comprises the amino acid sequence of SEQ ID NO: 9 and a N-terminal and/or C-terminal His-tag and/or HQ-tag such as SEQ ID NO: 12; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 547 of SEQ ID NO: 9. In another embodiment, the polypeptide comprises or consists of amino acids 1 to 555 of SEQ ID NO: 12. In an embodiment, the polypeptide has been isolated.

In a continuation of the twenty-third aspect, the invention relates to a GH5 polypeptide having xylanase activity encoded by a polynucleotide that hybridizes under high or very high stringency conditions with (i) the mature polypeptide coding sequence of SEQ ID NO: 7, (ii) the mature polypeptide coding sequence of SEQ ID NO: 10, or (iii) the full-length complement of (i) or (ii) (Sambrook et al., supra). In an embodiment, the polypeptide has been isolated.

In a continuation of the twenty-third aspect, the invention relates to a GH5 polypeptide having xylanase activity encoded by a polynucleotide having a sequence identity to the mature polypeptide coding sequence of SEQ ID NO: 7 or SEQ ID NO: 10 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-third aspect, the invention relates to variants of SEQ ID NO: 9 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 9 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 9 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 9 is not more than 10, e.g., 1, 2, 3, 4, 5, 6, 7, 8, 9 or 10. In another embodiment, the number of substitutions and/or deletions and/or insertions in SEQ ID NO: 9 is not more than 10, e.g., 1, 2, 3, 4, 5, 6, 7, 8, 9 or 10. In a further embodiment, the number of substitutions in SEQ ID NO: 9 is not more than 10, e.g., 1, 2, 3, 4, 5, 6, 7, 8, 9 or 10. In a further embodiment, the number of conservative substitutions in SEQ ID NO: 9 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Forth Aspect

In a twenty-fourth aspect, the invention relates to polypeptides having a sequence identity to the mature polypeptide of SEQ ID NO: 14 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 14.

In one embodiment, the polypeptide preferably comprises or consists of the amino acid sequence of SEQ ID NO: 14 or an allelic variant thereof; comprises the amino acid sequence of SEQ ID NO: 14 and a N-terminal and/or C-terminal His-tag and/or HQ-tag such as SEQ ID NO: 18 or the mature polypeptide of SEQ ID NO: 17; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 14. In another embodiment, the polypeptide comprises or consists of amino acids 1 to 598 of SEQ ID NO: 14. In another embodiment, the polypeptide comprises or consists of the mature polypeptide of SEQ ID NO: 17. In another embodiment, the polypeptide comprises or consists of amino acids 1 to 606 of SEQ ID NO: 17. In an embodiment, the polypeptide has been isolated.

In a continuation of the twenty-fourth aspect, the invention further relates to polypeptides having a sequence identity to SEQ ID NO: 15 of at least 80% which have xylanase activity. In an embodiment, the GH5 polypeptide has a sequence identity to SEQ ID NO: 15 of at least 85%. In an embodiment, the GH5 polypeptide has a sequence identity to SEQ ID NO: 15 of at least 86%. In an embodiment, the GH5 polypeptide has a sequence identity to SEQ ID NO: 15 of at least 87%. In an embodiment, the GH5 polypeptide has a sequence identity to SEQ ID NO: 15 of at least 88%. In an embodiment, the GH5 polypeptide has a sequence identity to SEQ ID NO: 15 of at least 89%. In an embodiment, the GH5 polypeptide has a sequence identity to SEQ ID NO: 15 of at least 90%. In an embodiment, the GH5 polypeptide has a sequence identity to SEQ ID NO: 15 of at least 91%. In an embodiment, the GH5 polypeptide has a sequence identity to SEQ ID NO: 15 of at least 92%. In an embodiment, the GH5 polypeptide has a sequence identity to SEQ ID NO: 15 of at least 93%. In an embodiment, the GH5 polypeptide has a sequence identity to SEQ ID NO: 15 of at least 94%. In an embodiment, the GH5 polypeptide has a sequence identity to SEQ ID NO: 15 of at least 95%. In an embodiment, the GH5 polypeptide has a sequence identity to SEQ ID NO: 15 of at least 96%. In an embodiment, the GH5 polypeptide has a sequence identity to SEQ ID NO: 15 of at least 97%. In an embodiment, the GH5 polypeptide has a sequence identity to SEQ ID NO: 15 of at least 98%. In an embodiment, the GH5 polypeptide has a sequence identity to SEQ ID NO: 15 of at least 99%. The polypeptides of the twenty-fourth aspect have at least 75%, preferably at least 90%, more preferably at least 95%, and most preferably at least 100% of the xylanase activity of SEQ ID NO: 15.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 15. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 18.

In one embodiment, the polypeptide preferably comprises or consists of the amino acid sequence of SEQ ID NO: 15 or an allelic variant thereof; comprises the amino acid sequence of SEQ ID NO: 15 and a N-terminal and/or C-terminal His-tag and/or HQ-tag such as SEQ ID NO: 18; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 598 of SEQ ID NO: 15. In another embodiment, the polypeptide comprises or consists of amino acids 1 to 606 of SEQ ID NO: 18. In an embodiment, the polypeptide has been isolated.

In a continuation of the twenty-fourth aspect, the invention relates to a GH5 polypeptide having xylanase activity encoded by a polynucleotide that hybridizes under high or very high stringency conditions with (i) the mature polypeptide coding sequence of SEQ ID NO: 13, (ii) the mature polypeptide coding sequence of SEQ ID NO: 16, or (iii) the full-length complement of (i) or (ii) (Sambrook et al., supra). In an embodiment, the polypeptide has been isolated.

In a continuation of the twenty-fourth aspect, the invention relates to a GH5 polypeptide having xylanase activity encoded by a polynucleotide having a sequence identity to the mature polypeptide coding sequence of SEQ ID NO: 13 or SEQ ID NO: 16 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-fourth aspect, the invention relates to variants of SEQ ID NO: 15 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 15 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 15 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 15 is not more than 10, e.g., 1, 2, 3, 4, 5, 6, 7, 8, 9 or 10. In another embodiment, the number of substitutions and/or deletions and/or insertions in SEQ ID NO: 15 is not more than 10, e.g., 1, 2, 3, 4, 5, 6, 7, 8, 9 or 10. In a further embodiment, the number of substitutions in SEQ ID NO: 15 is not more than 10, e.g., 1, 2, 3, 4, 5, 6, 7, 8, 9 or 10. In a further embodiment, the number of conservative substitutions in SEQ ID NO: 15 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Fifth Aspect

In a twenty-fifth aspect, the invention relates to polypeptides having a sequence identity to the mature polypeptide of SEQ ID NO: 26 at least 95%, e.g., at least 96%, at least 97%, at least 98%, at least 99%, or 100%, which have xylanase activity. In one embodiment, the polypeptides differ by up to 27 amino acids, e.g., between 1 and 27 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26 or 27 amino acids from the mature polypeptide of SEQ ID NO: 26.

In one embodiment, the polypeptide preferably comprises or consists of the amino acid sequence of SEQ ID NO: 26 or an allelic variant thereof; comprises the amino acid sequence of SEQ ID NO: 26 and a N-terminal and/or C-terminal His-tag and/or HQ-tag such as SEQ ID NO: 18 or the mature polypeptide of SEQ ID NO: 29; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 26. In another embodiment, the polypeptide comprises or consists of amino acids 1 to 550 of SEQ ID NO: 26. In another embodiment, the polypeptide comprises or consists of the mature polypeptide of SEQ ID NO: 29. In another embodiment, the polypeptide comprises or consists of amino acids 1 to 558 of SEQ ID NO: 29. In an embodiment, the polypeptide has been isolated.

In a continuation of the twenty-fifth aspect, the invention further relates to polypeptides having a sequence identity to SEQ ID NO: 27 of at least 95% which have xylanase activity. In an embodiment, the GH5 polypeptide has a sequence identity to SEQ ID NO: 27 of at least 96%. In an embodiment, the GH5 polypeptide has a sequence identity to SEQ ID NO: 27 of at least 97%. In an embodiment, the GH5 polypeptide has a sequence identity to SEQ ID NO: 27 of at least 98%. In an embodiment, the GH5 polypeptide has a sequence identity to SEQ ID NO: 27 of at least 99%. The polypeptides of the seventeenth aspect have at least 75%, preferably at least 90%, more preferably at least 95%, and most preferably at least 100% of the xylanase activity of SEQ ID NO: 27.

In one embodiment, the polypeptides differ by up to 27 amino acids, e.g., between 1 and 27 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26 or 27 amino acids from SEQ ID NO: 27. In one embodiment, the polypeptides differ by up to 27 amino acids, e.g., between 1 and 27 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26 or 27 amino acids from SEQ ID NO: 30.

In one embodiment, the polypeptide preferably comprises or consists of the amino acid sequence of SEQ ID NO: 27 or an allelic variant thereof; comprises the amino acid sequence of SEQ ID NO: 27 and a N-terminal and/or C-terminal His-tag and/or HQ-tag such as SEQ ID NO: 30; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 550 of SEQ ID NO: 27. In another embodiment, the polypeptide comprises or consists of amino acids 1 to 558 of SEQ ID NO: 30. In an embodiment, the polypeptide has been isolated.

In a continuation of the twenty-fifth aspect, the invention relates to polypeptides having a sequence identity to the mature polypeptide of SEQ ID NO: 29 at least 95%, e.g., at least 96%, at least 97%, at least 98%, at least 99%, or 100%, which have xylanase activity. In one embodiment, the polypeptides differ by up to 27 amino acids, e.g., between 1 and 27 amino acids, such as 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26 or 27 amino acids from the mature polypeptide of SEQ ID NO: 29.

In an embodiment, the polypeptide has been isolated. A polypeptide of the present invention preferably comprises or consists of the amino acid sequence of SEQ ID NO: 29 or an allelic variant thereof; or is a fragment thereof having xylanase activity. In another embodiment, the polypeptide comprises or consists of the mature polypeptide of SEQ ID NO: 29. In another embodiment, the polypeptide comprises or consists of amino acids 1 to 558 of SEQ ID NO: 29.

In a continuation of the twenty-fifth aspect, the invention relates to a GH5 polypeptide having xylanase activity encoded by a polynucleotide that hybridizes under high or very high stringency conditions with (i) the mature polypeptide coding sequence of SEQ ID NO: 25, (ii) the mature polypeptide coding sequence of SEQ ID NO: 28, or (iii) the full-length complement of (i) or (ii) (Sambrook et al., supra). In an embodiment, the polypeptide has been isolated.

In a continuation of the twenty-fifth aspect, the invention relates to a GH5 polypeptide having xylanase activity encoded by a polynucleotide having a sequence identity to the mature polypeptide coding sequence of SEQ ID NO: 25 or SEQ ID NO: 28 or the cDNA sequence thereof of at least 95%, e.g., at least 96%, at least 97%, at least 98%, at least 99%, or 100%. In a further embodiment, the polypeptide has been isolated.

In a continuation of the twenty-fifth aspect, the invention relates to variants of SEQ ID NO: 27 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 27 is not more than 27, e.g., 1, 2, 3, 4, 5, 6, 7, 8, 9, 10, 11, 12, 13, 14, 15, 16, 17, 18, 19, 20, 21, 22, 23, 24, 25, 26 or 27. In another embodiment, the number of positions comprising one or more amino acid substitutions, and/or one or more amino acid deletions, and/or one or more amino acid insertions or any combination thereof in SEQ ID NO: 27 is between 1 and 25, such as 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 27 is not more than 10, e.g., 1, 2, 3, 4, 5, 6, 7, 8, 9 or 10. In another embodiment, the number of substitutions and/or deletions and/or insertions in SEQ ID NO: 27 is not more than 10, e.g., 1, 2, 3, 4, 5, 6, 7, 8, 9 or 10. In a further embodiment, the number of substitutions in SEQ ID NO: 27 is not more than 10, e.g., 1, 2, 3, 4, 5, 6, 7, 8, 9 or 10. In a further embodiment, the number of conservative substitutions in SEQ ID NO: 27 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Sixth Aspect

In a twenty-sixth aspect, the invention relates to polypeptides having a sequence identity to the mature polypeptide of SEQ ID NO: 32 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 32.

In one embodiment, the polypeptide preferably comprises or consists of the amino acid sequence of SEQ ID NO: 32 or an allelic variant thereof; comprises the amino acid sequence of SEQ ID NO: 32 and a N-terminal and/or C-terminal His-tag and/or HQ-tag such as SEQ ID NO: 36 or the mature polypeptide of SEQ ID NO: 35; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 32. In another embodiment, the polypeptide comprises or consists of amino acids 1 to 631 of SEQ ID NO: 32. In another embodiment, the polypeptide comprises or consists of the mature polypeptide of SEQ ID NO: 35. In another embodiment, the polypeptide comprises or consists of amino acids 1 to 639 of SEQ ID NO: 35. In an embodiment, the polypeptide has been isolated.

In a continuation of the twenty-sixth aspect, the invention further relates to polypeptides having a sequence identity to SEQ ID NO: 33 of at least 80% which have xylanase activity. In an embodiment, the GH5 polypeptide has a sequence identity to SEQ ID NO: 33 of at least 85%. In an embodiment, the GH5 polypeptide has a sequence identity to SEQ ID NO: 33 of at least 86%. In an embodiment, the GH5 polypeptide has a sequence identity to SEQ ID NO: 33 of at least 87%. In an embodiment, the GH5 polypeptide has a sequence identity to SEQ ID NO: 33 of at least 88%. In an embodiment, the GH5 polypeptide has a sequence identity to SEQ ID NO: 33 of at least 89%. In an embodiment, the GH5 polypeptide has a sequence identity to SEQ ID NO: 33 of at least 90%. In an embodiment, the GH5 polypeptide has a sequence identity to SEQ ID NO: 33 of at least 91%. In an embodiment, the GH5 polypeptide has a sequence identity to SEQ ID NO: 33 of at least 92%. In an embodiment, the GH5 polypeptide has a sequence identity to SEQ ID NO: 33 of at least 93%. In an embodiment, the GH5 polypeptide has a sequence identity to SEQ ID NO: 33 of at least 94%. In an embodiment, the GH5 polypeptide has a sequence identity to SEQ ID NO: 33 of at least 95%. In an embodiment, the GH5 polypeptide has a sequence identity to SEQ ID NO: 33 of at least 96%. In an embodiment, the GH5 polypeptide has a sequence identity to SEQ ID NO: 33 of at least 97%. In an embodiment, the GH5 polypeptide has a sequence identity to SEQ ID NO: 33 of at least 98%. In an embodiment, the GH5 polypeptide has a sequence identity to SEQ ID NO: 33 of at least 99%. The polypeptides of the seventeenth aspect have at least 75%, preferably at least 90%, more preferably at least 95%, and most preferably at least 100% of the xylanase activity of SEQ ID NO: 33.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 33. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 36.

In one embodiment, the polypeptide preferably comprises or consists of the amino acid sequence of SEQ ID NO: 33 or an allelic variant thereof; comprises the amino acid sequence of SEQ ID NO: 33 and a N-terminal and/or C-terminal His-tag and/or HQ-tag such as SEQ ID NO: 36; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 631 of SEQ ID NO: 33. In another embodiment, the polypeptide comprises or consists of amino acids 1 to 639 of SEQ ID NO: 36. In an embodiment, the polypeptide has been isolated.

In a continuation of the twenty-sixth aspect, the invention relates to a GH5 polypeptide having xylanase activity encoded by a polynucleotide that hybridizes under high or very high stringency conditions with (i) the mature polypeptide coding sequence of SEQ ID NO: 31, (ii) the mature polypeptide coding sequence of SEQ ID NO: 34, or (iii) the full-length complement of (i) or (ii) (Sambrook et al., supra). In an embodiment, the polypeptide has been isolated.

In a continuation of the twenty-sixth aspect, the invention relates to a GH5 polypeptide having xylanase activity encoded by a polynucleotide having a sequence identity to the mature polypeptide coding sequence of SEQ ID NO: 31 or SEQ ID NO: 34 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-sixth aspect, the invention relates to variants of SEQ ID NO: 33 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 33 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 33 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 33 is not more than 10, e.g., 1, 2, 3, 4, 5, 6, 7, 8, 9 or 10. In another embodiment, the number of substitutions and/or deletions and/or insertions in SEQ ID NO: 33 is not more than 10, e.g., 1, 2, 3, 4, 5, 6, 7, 8, 9 or 10. In a further embodiment, the number of substitutions in SEQ ID NO: 33 is not more than 10, e.g., 1, 2, 3, 4, 5, 6, 7, 8, 9 or 10. In a further embodiment, the number of conservative substitutions in SEQ ID NO: 33 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Seventh Aspect

In a twenty-seventh aspect, the invention relates to polypeptides having a sequence identity to the mature polypeptide of SEQ ID NO: 38 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 38.

In one embodiment, the polypeptide preferably comprises or consists of the amino acid sequence of SEQ ID NO: 38 or an allelic variant thereof; comprises the amino acid sequence of SEQ ID NO: 38 and a N-terminal and/or C-terminal His-tag and/or HQ-tag such as SEQ ID NO: 42 or the mature polypeptide of SEQ ID NO: 41; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 38. In another embodiment, the polypeptide comprises or consists of amino acids 1 to 828 of SEQ ID NO: 38. In another embodiment, the polypeptide comprises or consists of the mature polypeptide of SEQ ID NO: 41. In another embodiment, the polypeptide comprises or consists of amino acids 1 to 836 of SEQ ID NO: 41. In an embodiment, the polypeptide has been isolated.

In a continuation of the twenty-seventh aspect, the invention further relates to polypeptides having a sequence identity to SEQ ID NO: 39 of at least 80% which have xylanase activity. In an embodiment, the GH5 polypeptide has a sequence identity to SEQ ID NO: 39 of at least 85%. In an embodiment, the GH5 polypeptide has a sequence identity to SEQ ID NO: 39 of at least 86%. In an embodiment, the GH5 polypeptide has a sequence identity to SEQ ID NO: 39 of at least 87%. In an embodiment, the GH5 polypeptide has a sequence identity to SEQ ID NO: 39 of at least 88%. In an embodiment, the GH5 polypeptide has a sequence identity to SEQ ID NO: 39 of at least 89%. In an embodiment, the GH5 polypeptide has a sequence identity to SEQ ID NO: 39 of at least 90%. In an embodiment, the GH5 polypeptide has a sequence identity to SEQ ID NO: 39 of at least 91%. In an embodiment, the GH5 polypeptide has a sequence identity to SEQ ID NO: 39 of at least 92%. In an embodiment, the GH5 polypeptide has a sequence identity to SEQ ID NO: 39 of at least 93%. In an embodiment, the GH5 polypeptide has a sequence identity to SEQ ID NO: 39 of at least 94%. In an embodiment, the GH5 polypeptide has a sequence identity to SEQ ID NO: 39 of at least 95%. In an embodiment, the GH5 polypeptide has a sequence identity to SEQ ID NO: 39 of at least 96%. In an embodiment, the GH5 polypeptide has a sequence identity to SEQ ID NO: 39 of at least 97%. In an embodiment, the GH5 polypeptide has a sequence identity to SEQ ID NO: 39 of at least 98%. In an embodiment, the GH5 polypeptide has a sequence identity to SEQ ID NO: 39 of at least 99%. The polypeptides of the seventeenth aspect have at least 75%, preferably at least 90%, more preferably at least 95%, and most preferably at least 100% of the xylanase activity of SEQ ID NO: 39.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 39. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 42.

In one embodiment, the polypeptide preferably comprises or consists of the amino acid sequence of SEQ ID NO: 39 or an allelic variant thereof; comprises the amino acid sequence of SEQ ID NO: 39 and a N-terminal and/or C-terminal His-tag and/or HQ-tag such as SEQ ID NO: 42; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 828 of SEQ ID NO: 39. In another embodiment, the polypeptide comprises or consists of amino acids 1 to 836 of SEQ ID NO: 42. In an embodiment, the polypeptide has been isolated.

In a continuation of the twenty-seventh aspect, the invention relates to a GH5 polypeptide having xylanase activity encoded by a polynucleotide that hybridizes under high or very high stringency conditions with (i) the mature polypeptide coding sequence of SEQ ID NO: 37, (ii) the mature polypeptide coding sequence of SEQ ID NO: 40, or (iii) the full-length complement of (i) or (ii) (Sambrook et al., supra). In an embodiment, the polypeptide has been isolated.

In a continuation of the twenty-seventh aspect, the invention relates to a GH5 polypeptide having xylanase activity encoded by a polynucleotide having a sequence identity to the mature polypeptide coding sequence of SEQ ID NO: 37 or SEQ ID NO: 40 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-seventh aspect, the invention relates to variants of SEQ ID NO: 39 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 39 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 39 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 39 is not more than 10, e.g., 1, 2, 3, 4, 5, 6, 7, 8, 9 or 10. In another embodiment, the number of substitutions and/or deletions and/or insertions in SEQ ID NO: 39 is not more than 10, e.g., 1, 2, 3, 4, 5, 6, 7, 8, 9 or 10. In a further embodiment, the number of substitutions in SEQ ID NO: 39 is not more than 10, e.g., 1, 2, 3, 4, 5, 6, 7, 8, 9 or 10. In a further embodiment, the number of conservative substitutions in SEQ ID NO: 39 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Eighth Aspect

In a twenty-eighth aspect, the invention relates to polypeptides having a sequence identity to the mature polypeptide of SEQ ID NO: 44 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 44.

In one embodiment, the polypeptide preferably comprises or consists of the amino acid sequence of SEQ ID NO: 44 or an allelic variant thereof; comprises the amino acid sequence of SEQ ID NO: 44 and a N-terminal and/or C-terminal His-tag and/or HQ-tag such as SEQ ID NO: 48 or the mature polypeptide of SEQ ID NO: 47; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 44. In another embodiment, the polypeptide comprises or consists of amino acids 1 to 577 of SEQ ID NO: 44. In another embodiment, the polypeptide comprises or consists of the mature polypeptide of SEQ ID NO: 47. In another embodiment, the polypeptide comprises or consists of amino acids 1 to 585 of SEQ ID NO: 47. In an embodiment, the polypeptide has been isolated.

In a continuation of the twenty-eighth aspect, the invention further relates to polypeptides having a sequence identity to SEQ ID NO: 45 of at least 80% which have xylanase activity. In an embodiment, the GH5 polypeptide has a sequence identity to SEQ ID NO: 45 of at least 85%. In an embodiment, the GH5 polypeptide has a sequence identity to SEQ ID NO: 45 of at least 86%. In an embodiment, the GH5 polypeptide has a sequence identity to SEQ ID NO: 45 of at least 87%. In an embodiment, the GH5 polypeptide has a sequence identity to SEQ ID NO: 45 of at least 88%. In an embodiment, the GH5 polypeptide has a sequence identity to SEQ ID NO: 45 of at least 89%. In an embodiment, the GH5 polypeptide has a sequence identity to SEQ ID NO: 45 of at least 90%. In an embodiment, the GH5 polypeptide has a sequence identity to SEQ ID NO: 45 of at least 91%. In an embodiment, the GH5 polypeptide has a sequence identity to SEQ ID NO: 45 of at least 92%. In an embodiment, the GH5 polypeptide has a sequence identity to SEQ ID NO: 45 of at least 93%. In an embodiment, the GH5 polypeptide has a sequence identity to SEQ ID NO: 45 of at least 94%. In an embodiment, the GH5 polypeptide has a sequence identity to SEQ ID NO: 45 of at least 95%. In an embodiment, the GH5 polypeptide has a sequence identity to SEQ ID NO: 45 of at least 96%. In an embodiment, the GH5 polypeptide has a sequence identity to SEQ ID NO: 45 of at least 97%. In an embodiment, the GH5 polypeptide has a sequence identity to SEQ ID NO: 45 of at least 98%. In an embodiment, the GH5 polypeptide has a sequence identity to SEQ ID NO: 45 of at least 99%. The polypeptides of the seventeenth aspect have at least 75%, preferably at least 90%, more preferably at least 95%, and most preferably at least 100% of the xylanase activity of SEQ ID NO: 45.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 45. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 48.

In one embodiment, the polypeptide preferably comprises or consists of the amino acid sequence of SEQ ID NO: 45 or an allelic variant thereof; comprises the amino acid sequence of SEQ ID NO: 45 and a N-terminal and/or C-terminal His-tag and/or HQ-tag such as SEQ ID NO: 48; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 577 of SEQ ID NO: 45. In another embodiment, the polypeptide comprises or consists of amino acids 1 to 585 of SEQ ID NO: 48. In an embodiment, the polypeptide has been isolated.

In a continuation of the twenty-eighth aspect, the invention relates to a GH5 polypeptide having xylanase activity encoded by a polynucleotide that hybridizes under high or very high stringency conditions with (i) the mature polypeptide coding sequence of SEQ ID NO: 43, (ii) the mature polypeptide coding sequence of SEQ ID NO: 46, or (iii) the full-length complement of (i) or (ii) (Sambrook et al., supra). In an embodiment, the polypeptide has been isolated.

In a continuation of the twenty-eighth aspect, the invention relates to a GH5 polypeptide having xylanase activity encoded by a polynucleotide having a sequence identity to the mature polypeptide coding sequence of SEQ ID NO: 43 or SEQ ID NO: 46 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the twenty-eighth aspect, the invention relates to variants of SEQ ID NO: 45 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 45 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 45 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 45 is not more than 10, e.g., 1, 2, 3, 4, 5, 6, 7, 8, 9 or 10. In another embodiment, the number of substitutions and/or deletions and/or insertions in SEQ ID NO: 45 is not more than 10, e.g., 1, 2, 3, 4, 5, 6, 7, 8, 9 or 10. In a further embodiment, the number of substitutions in SEQ ID NO: 45 is not more than 10, e.g., 1, 2, 3, 4, 5, 6, 7, 8, 9 or 10. In a further embodiment, the number of conservative substitutions in SEQ ID NO: 45 is not more than 10, e.g., 1, 2, 3, 4, 5, 6, 7, 8, 9 or 10. Examples of amino acid changes, conservative substitutions and fusion peptides are described in the fourth aspect of the invention.

Twenty-Ninth Aspect

In a twenty-ninth aspect, the invention relates to polypeptides having a sequence identity to the mature polypeptide of SEQ ID NO: 66 at least 97.5%, e.g., at least 98%, at least 98.5%, at least 99%, at least 99.5% or 100%, which have xylanase activity. In one embodiment, the polypeptides differ by up to 14 amino acids, e.g., between 1 and 14 amino acids, such as 1-10 or 1-5 amino acids, or 1, 2, 3, 4, 5, 6, 7, 8, 9, 10, 11, 12, 13 or 14 amino acids from the mature polypeptide of SEQ ID NO: 66.

In one embodiment, the polypeptide preferably comprises or consists of the amino acid sequence of SEQ ID NO: 66 or an allelic variant thereof; comprises the amino acid sequence of SEQ ID NO: 66 and a N-terminal and/or C-terminal His-tag and/or HQ-tag such as SEQ ID NO: 70 or the mature polypeptide of SEQ ID NO: 69; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 66. In another embodiment, the polypeptide comprises or consists of amino acids 1 to 537 of SEQ ID NO: 66. In another embodiment, the polypeptide comprises or consists of the mature polypeptide of SEQ ID NO: 69. In another embodiment, the polypeptide comprises or consists of amino acids 1 to 545 of SEQ ID NO: 69. In an embodiment, the polypeptide has been isolated.

In a continuation of the twenty-ninth aspect, the invention further relates to polypeptides having a sequence identity to SEQ ID NO: 67 of at least 97.5% which have xylanase activity. In an embodiment, the GH5 polypeptide has a sequence identity to SEQ ID NO: 67 of at least 97.5%. In an embodiment, the GH5 polypeptide has a sequence identity to SEQ ID NO: 67 of at least 98%. In an embodiment, the GH5 polypeptide has a sequence identity to SEQ ID NO: 67 of at least 98.5%. In an embodiment, the GH5 polypeptide has a sequence identity to SEQ ID NO: 67 of at least 99%. In an embodiment, the GH5 polypeptide has a sequence identity to SEQ ID NO: 67 of at least 99.5%. The polypeptides of the seventeenth aspect have at least 75%, preferably at least 90%, more preferably at least 95%, and most preferably at least 100% of the xylanase activity of SEQ ID NO: 67.

In one embodiment, the polypeptides differ by up to 16 amino acids, e.g., between 1 and 14 amino acids, e.g., between 1 and 14 amino acids, such as 1-10 or 1-5 amino acids, or 1, 2, 3, 4, 5, 6, 7, 8, 9, 10, 11, 12, 13 or 14 amino acids from SEQ ID NO: 67. In one embodiment, the polypeptides differ by up to 14 amino acids, e.g., between 1 and 14 amino acids, such as 1-10 or 1-5 amino acids, or 1, 2, 3, 4, 5, 6, 7, 8, 9, 10, 11, 12, 13 or 14 amino acids from SEQ ID NO: 70.

In one embodiment, the polypeptide preferably comprises or consists of the amino acid sequence of SEQ ID NO: 67 or an allelic variant thereof; comprises the amino acid sequence of SEQ ID NO: 67 and a N-terminal and/or C-terminal His-tag and/or HQ-tag such as SEQ ID NO: 70; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 67. In another embodiment, the polypeptide comprises or consists of amino acids 1 to 545 of SEQ ID NO: 70. In an embodiment, the polypeptide has been isolated.

In a continuation of the twenty-ninth aspect, the invention relates to a GH5 polypeptide having xylanase activity encoded by a polynucleotide that hybridizes under high or very high stringency conditions with (i) the mature polypeptide coding sequence of SEQ ID NO: 65, (ii) the mature polypeptide coding sequence of SEQ ID NO: 68, or (iii) the full-length complement of (i) or (ii) (Sambrook et al., supra). In an embodiment, the polypeptide has been isolated.

In a continuation of the twenty-ninth aspect, the invention relates to a GH5 polypeptide having xylanase activity encoded by a polynucleotide having a sequence identity to the mature polypeptide coding sequence of SEQ ID NO: 65 or SEQ ID NO: 68 or the cDNA sequence thereof of at least 97.5%, e.g., at least 98%, at least 98.5%, at least 99%, at least 99.5% or 100%. In a further embodiment, the polypeptide has been isolated.

In a continuation of the twenty-ninth aspect, the invention relates to variants of SEQ ID NO: 67 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 67 is not more than 14, e.g., 1, 2, 3, 4, 5, 6, 7, 8, 9, 10, 11, 12, 13 or 14. In another embodiment, the number of positions comprising one or more amino acid substitutions, and/or one or more amino acid deletions, and/or one or more amino acid insertions or any combination thereof in SEQ ID NO: 67 is between 1 and 14, such as 1-10 or 1-5 positions. In an embodiment, the number of positions comprising one or more amino acid substitutions, and/or one or more amino acid deletions, and/or one or more amino acid insertions or any combination thereof in SEQ ID NO: 67 is not more than 10, e.g., 1, 2, 3, 4, 5, 6, 7, 8, 9 or 10. In another embodiment, the number of substitutions and/or deletions and/or insertions in SEQ ID NO: 67 is not more than 10, e.g., 1, 2, 3, 4, 5, 6, 7, 8, 9 or 10. In a further embodiment, the number of substitutions in SEQ ID NO: 67 is not more than 10, e.g., 1, 2, 3, 4, 5, 6, 7, 8, 9 or 10. In a further embodiment, the number of conservative substitutions in SEQ ID NO: 67 is not more than 10, e.g., 1, 2, 3, 4, 5, 6, 7, 8, 9 or 10. Examples of amino acid changes, conservative substitutions and fusion peptides are described in the fourth aspect of the invention.

Thirtieth Aspect

In a thirtieth aspect, the invention relates to polypeptides having a sequence identity to the mature polypeptide of SEQ ID NO: 72 at least 98.8%, e.g., at least 99.0%, at least 99.2%, at least 99.4%, at least 99.6%, at least 99.8% or 100%, which have xylanase activity. In one embodiment, the polypeptides differ by up to 6 amino acids, e.g., between 1 and 6 amino acids, such as 1-5 amino acids, or 1, 2, 3, 4, 5 or 6 amino acids from the mature polypeptide of SEQ ID NO: 72.

In one embodiment, the polypeptide preferably comprises or consists of the amino acid sequence of SEQ ID NO: 72 or an allelic variant thereof; comprises the amino acid sequence of SEQ ID NO: 72 and a N-terminal and/or C-terminal His-tag and/or HQ-tag such as SEQ ID NO: 76 or the mature polypeptide of SEQ ID NO: 75; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 72. In another embodiment, the polypeptide comprises or consists of amino acids 1 to 536 of SEQ ID NO: 72. In another embodiment, the polypeptide comprises or consists of the mature polypeptide of SEQ ID NO: 75. In another embodiment, the polypeptide comprises or consists of amino acids 1 to 544 of SEQ ID NO: 75. In an embodiment, the polypeptide has been isolated.

In a continuation of the thirtieth aspect, the invention further relates to polypeptides having a sequence identity to SEQ ID NO: 73 of at least 98.8% which have xylanase activity. In an embodiment, the GH5 polypeptide has a sequence identity to SEQ ID NO: 73 of at least 99.0%. In an embodiment, the GH5 polypeptide has a sequence identity to SEQ ID NO: 73 of at least 99.2%. In an embodiment, the GH5 polypeptide has a sequence identity to SEQ ID NO: 73 of at least 99.4%. In an embodiment, the GH5 polypeptide has a sequence identity to SEQ ID NO: 73 of at least 99.6%. In an embodiment, the GH5 polypeptide has a sequence identity to SEQ ID NO: 73 of at least 99.8%. The polypeptides of the seventeenth aspect have at least 75%, preferably at least 90%, more preferably at least 95%, and most preferably at least 100% of the xylanase activity of SEQ ID NO: 73.

In one embodiment, the polypeptides differ by up to 6 amino acids, e.g., between 1 and 6 amino acids, such as 1-5 amino acids, or 1, 2, 3, 4, 5 or 6 amino acids from SEQ ID NO: 73. In one embodiment, the polypeptides differ by up to 6 amino acids, e.g., between 1 and 6 amino acids, such as 1-5 amino acids, or 1, 2, 3, 4, 5 or 6 amino acids from SEQ ID NO: 76.

In one embodiment, the polypeptide preferably comprises or consists of the amino acid sequence of SEQ ID NO: 73 or an allelic variant thereof; comprises the amino acid sequence of SEQ ID NO: 73 and a N-terminal and/or C-terminal His-tag and/or HQ-tag such as SEQ ID NO: 76; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 73. In another embodiment, the polypeptide comprises or consists of amino acids 1 to 544 of SEQ ID NO: 76. In an embodiment, the polypeptide has been isolated.

In a continuation of the thirtieth aspect, the invention relates to a GH5 polypeptide having xylanase activity encoded by a polynucleotide that hybridizes under high or very high stringency conditions with (i) the mature polypeptide coding sequence of SEQ ID NO: 71, (ii) the mature polypeptide coding sequence of SEQ ID NO: 74, or (iii) the full-length complement of (i) or (ii) (Sambrook et al., supra). In an embodiment, the polypeptide has been isolated.

In a continuation of the thirtieth aspect, the invention relates to a GH5 polypeptide having xylanase activity encoded by a polynucleotide having a sequence identity to the mature polypeptide coding sequence of SEQ ID NO: 71 or SEQ ID NO: 74 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirtieth aspect, the invention relates to variants of SEQ ID NO: 73 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 73 is not more than 6, e.g., 1, 2, 3, 4, 5 or 6. In another embodiment, the number of positions comprising one or more amino acid substitutions, and/or one or more amino acid deletions, and/or one or more amino acid insertions or any combination thereof in SEQ ID NO: 73 is between 1 and 6, such as 1-5 positions. In an embodiment, the number of positions comprising one or more amino acid substitutions, and/or one or more amino acid deletions, and/or one or more amino acid insertions or any combination thereof in SEQ ID NO: 73 is not more than 6, e.g., 1, 2, 3, 4, 5 or 6. In another embodiment, the number of substitutions and/or deletions and/or insertions in SEQ ID NO: 73 is not more than 6, e.g., 1, 2, 3, 4, 5 or 6. In a further embodiment, the number of substitutions in SEQ ID NO: 73 is not more than 6, e.g., 1, 2, 3, 4, 5 or 6. In a further embodiment, the number of conservative substitutions in SEQ ID NO: 73 is not more than 6, e.g., 1, 2, 3, 4, 5 or 6. Examples of amino acid changes, conservative substitutions and fusion peptides are described in the fourth aspect of the invention.

Thirty-First Aspect

In a thirty-first aspect, the invention relates to polypeptides having a sequence identity to the mature polypeptide of SEQ ID NO: 78 at least 83%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 78.

In one embodiment, the polypeptide preferably comprises or consists of the amino acid sequence of SEQ ID NO: 78 or an allelic variant thereof; comprises the amino acid sequence of SEQ ID NO: 78 and a N-terminal and/or C-terminal His-tag and/or HQ-tag such as SEQ ID NO: 82 or the mature polypeptide of SEQ ID NO: 81; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 78. In another embodiment, the polypeptide comprises or consists of amino acids 1 to 536 of SEQ ID NO: 78. In another embodiment, the polypeptide comprises or consists of the mature polypeptide of SEQ ID NO: 81. In another embodiment, the polypeptide comprises or consists of amino acids 1 to 544 of SEQ ID NO: 81. In an embodiment, the polypeptide has been isolated.

In a continuation of the thirty-first aspect, the invention further relates to polypeptides having a sequence identity to SEQ ID NO: 79 of at least 83% which have xylanase activity. In an embodiment, the GH5 polypeptide has a sequence identity to SEQ ID NO: 79 of at least 85%. In an embodiment, the GH5 polypeptide has a sequence identity to SEQ ID NO: 79 of at least 86%. In an embodiment, the GH5 polypeptide has a sequence identity to SEQ ID NO: 79 of at least 87%. In an embodiment, the GH5 polypeptide has a sequence identity to SEQ ID NO: 79 of at least 88%. In an embodiment, the GH5 polypeptide has a sequence identity to SEQ ID NO: 79 of at least 89%. In an embodiment, the GH5 polypeptide has a sequence identity to SEQ ID NO: 79 of at least 90%. In an embodiment, the GH5 polypeptide has a sequence identity to SEQ ID NO: 79 of at least 91%. In an embodiment, the GH5 polypeptide has a sequence identity to SEQ ID NO: 79 of at least 92%. In an embodiment, the GH5 polypeptide has a sequence identity to SEQ ID NO: 79 of at least 93%. In an embodiment, the GH5 polypeptide has a sequence identity to SEQ ID NO: 79 of at least 94%. In an embodiment, the GH5 polypeptide has a sequence identity to SEQ ID NO: 79 of at least 95%. In an embodiment, the GH5 polypeptide has a sequence identity to SEQ ID NO: 79 of at least 96%. In an embodiment, the GH5 polypeptide has a sequence identity to SEQ ID NO: 79 of at least 97%. In an embodiment, the GH5 polypeptide has a sequence identity to SEQ ID NO: 79 of at least 98%. In an embodiment, the GH5 polypeptide has a sequence identity to SEQ ID NO: 79 of at least 99%. The polypeptides of the seventeenth aspect have at least 75%, preferably at least 90%, more preferably at least 95%, and most preferably at least 100% of the xylanase activity of SEQ ID NO: 79.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 79. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 82.

In one embodiment, the polypeptide preferably comprises or consists of the amino acid sequence of SEQ ID NO: 79 or an allelic variant thereof; comprises the amino acid sequence of SEQ ID NO: 79 and a N-terminal and/or C-terminal His-tag and/or HQ-tag such as SEQ ID NO: 82; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 79. In another embodiment, the polypeptide comprises or consists of amino acids 1 to 544 of SEQ ID NO: 82. In an embodiment, the polypeptide has been isolated.

In a continuation of the thirty-first aspect, the invention relates to a GH5 polypeptide having xylanase activity encoded by a polynucleotide that hybridizes under high or very high stringency conditions with (i) the mature polypeptide coding sequence of SEQ ID NO: 77, (ii) the mature polypeptide coding sequence of SEQ ID NO: 80, or (iii) the full-length complement of (i) or (ii) (Sambrook et al., supra). In an embodiment, the polypeptide has been isolated.

In a continuation of the thirty-first aspect, the invention relates to a GH5 polypeptide having xylanase activity encoded by a polynucleotide having a sequence identity to the mature polypeptide coding sequence of SEQ ID NO: 77 or SEQ ID NO: 80 or the cDNA sequence thereof of at least 83%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-first aspect, the invention relates to variants of SEQ ID NO: 79 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 79 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 79 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 79 is not more than 10, e.g., 1, 2, 3, 4, 5, 6, 7, 8, 9 or 10. In another embodiment, the number of substitutions and/or deletions and/or insertions in SEQ ID NO: 79 is not more than 10, e.g., 1, 2, 3, 4, 5, 6, 7, 8, 9 or 10. In a further embodiment, the number of substitutions in SEQ ID NO: 79 is not more than 10, e.g., 1, 2, 3, 4, 5, 6, 7, 8, 9 or 10. In a further embodiment, the number of conservative substitutions in SEQ ID NO: 79 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Second Aspect

In a thirty-second aspect, the invention relates to polypeptides having a sequence identity to the mature polypeptide of SEQ ID NO: 84 at least 90%, e.g., at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 84.

In one embodiment, the polypeptide preferably comprises or consists of the amino acid sequence of SEQ ID NO: 84 or an allelic variant thereof; comprises the amino acid sequence of SEQ ID NO: 84 and a N-terminal and/or C-terminal His-tag and/or HQ-tag such as SEQ ID NO: 88 or the mature polypeptide of SEQ ID NO: 87; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 84. In another embodiment, the polypeptide comprises or consists of amino acids 1 to 535 of SEQ ID NO: 84. In another embodiment, the polypeptide comprises or consists of the mature polypeptide of SEQ ID NO: 87. In another embodiment, the polypeptide comprises or consists of amino acids 1 to 543 of SEQ ID NO: 87. In an embodiment, the polypeptide has been isolated.

In a continuation of the thirty-second aspect, the invention further relates to polypeptides having a sequence identity to SEQ ID NO: 85 of at least 90% which have xylanase activity. In an embodiment, the GH5 polypeptide has a sequence identity to SEQ ID NO: 85 of at least 91%. In an embodiment, the GH5 polypeptide has a sequence identity to SEQ ID NO: 85 of at least 92%. In an embodiment, the GH5 polypeptide has a sequence identity to SEQ ID NO: 85 of at least 93%. In an embodiment, the GH5 polypeptide has a sequence identity to SEQ ID NO: 85 of at least 94%. In an embodiment, the GH5 polypeptide has a sequence identity to SEQ ID NO: 85 of at least 95%. In an embodiment, the GH5 polypeptide has a sequence identity to SEQ ID NO: 85 of at least 96%. In an embodiment, the GH5 polypeptide has a sequence identity to SEQ ID NO: 85 of at least 97%. In an embodiment, the GH5 polypeptide has a sequence identity to SEQ ID NO: 85 of at least 98%. In an embodiment, the GH5 polypeptide has a sequence identity to SEQ ID NO: 85 of at least 99%. The polypeptides of the seventeenth aspect have at least 75%, preferably at least 90%, more preferably at least 95%, and most preferably at least 100% of the xylanase activity of SEQ ID NO: 85.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 85. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 88.

In one embodiment, the polypeptide preferably comprises or consists of the amino acid sequence of SEQ ID NO: 85 or an allelic variant thereof; comprises the amino acid sequence of SEQ ID NO: 85 and a N-terminal and/or C-terminal His-tag and/or HQ-tag such as SEQ ID NO: 88; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 535 of SEQ ID NO: 85. In another embodiment, the polypeptide comprises or consists of amino acids 1 to 543 of SEQ ID NO: 88. In an embodiment, the polypeptide has been isolated.

In a continuation of the thirty-second aspect, the invention relates to a GH5 polypeptide having xylanase activity encoded by a polynucleotide that hybridizes under high or very high stringency conditions with (i) the mature polypeptide coding sequence of SEQ ID NO: 83, (ii) the mature polypeptide coding sequence of SEQ ID NO: 86, or (iii) the full-length complement of (i) or (ii) (Sambrook et al., supra). In an embodiment, the polypeptide has been isolated.

In a continuation of the thirty-second aspect, the invention relates to a GH5 polypeptide having xylanase activity encoded by a polynucleotide having a sequence identity to the mature polypeptide coding sequence of SEQ ID NO: 83 or SEQ ID NO: 86 or the cDNA sequence thereof of at least 90%, e.g., at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-second aspect, the invention relates to variants of SEQ ID NO: 85 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 85 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 85 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 85 is not more than 10, e.g., 1, 2, 3, 4, 5, 6, 7, 8, 9 or 10. In another embodiment, the number of substitutions and/or deletions and/or insertions in SEQ ID NO: 85 is not more than 10, e.g., 1, 2, 3, 4, 5, 6, 7, 8, 9 or 10. In a further embodiment, the number of substitutions in SEQ ID NO: 85 is not more than 10, e.g., 1, 2, 3, 4, 5, 6, 7, 8, 9 or 10. In a further embodiment, the number of conservative substitutions in SEQ ID NO: 85 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Third Aspect

In a thirty-third aspect, the invention relates to polypeptides having a sequence identity to the mature polypeptide of SEQ ID NO: 90 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 90.

In one embodiment, the polypeptide preferably comprises or consists of the amino acid sequence of SEQ ID NO: 90 or an allelic variant thereof; comprises the amino acid sequence of SEQ ID NO: 90 and a N-terminal and/or C-terminal His-tag and/or HQ-tag such as SEQ ID NO: 94 or the mature polypeptide of SEQ ID NO: 93; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 90. In another embodiment, the polypeptide comprises or consists of amino acids 1 to 536 of SEQ ID NO: 90. In another embodiment, the polypeptide comprises or consists of the mature polypeptide of SEQ ID NO: 93. In another embodiment, the polypeptide comprises or consists of amino acids 1 to 544 of SEQ ID NO: 93. In an embodiment, the polypeptide has been isolated.

In a continuation of the thirty-third aspect, the invention further relates to polypeptides having a sequence identity to SEQ ID NO: 91 of at least 80% which have xylanase activity. In an embodiment, the GH5 polypeptide has a sequence identity to SEQ ID NO: 91 of at least 85%. In an embodiment, the GH5 polypeptide has a sequence identity to SEQ ID NO: 91 of at least 86%. In an embodiment, the GH5 polypeptide has a sequence identity to SEQ ID NO: 91 of at least 87%. In an embodiment, the GH5 polypeptide has a sequence identity to SEQ ID NO: 91 of at least 88%. In an embodiment, the GH5 polypeptide has a sequence identity to SEQ ID NO: 91 of at least 89%. In an embodiment, the GH5 polypeptide has a sequence identity to SEQ ID NO: 91 of at least 90%. In an embodiment, the GH5 polypeptide has a sequence identity to SEQ ID NO: 91 of at least 91%. In an embodiment, the GH5 polypeptide has a sequence identity to SEQ ID NO: 91 of at least 92%. In an embodiment, the GH5 polypeptide has a sequence identity to SEQ ID NO: 91 of at least 93%. In an embodiment, the GH5 polypeptide has a sequence identity to SEQ ID NO: 91 of at least 94%. In an embodiment, the GH5 polypeptide has a sequence identity to SEQ ID NO: 91 of at least 95%. In an embodiment, the GH5 polypeptide has a sequence identity to SEQ ID NO: 91 of at least 96%. In an embodiment, the GH5 polypeptide has a sequence identity to SEQ ID NO: 91 of at least 97%. In an embodiment, the GH5 polypeptide has a sequence identity to SEQ ID NO: 91 of at least 98%. In an embodiment, the GH5 polypeptide has a sequence identity to SEQ ID NO: 91 of at least 99%. The polypeptides of the seventeenth aspect have at least 75%, preferably at least 90%, more preferably at least 95%, and most preferably at least 100% of the xylanase activity of SEQ ID NO: 91.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 91. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 94.

In one embodiment, the polypeptide preferably comprises or consists of the amino acid sequence of SEQ ID NO: 91 or an allelic variant thereof; comprises the amino acid sequence of SEQ ID NO: 91 and a N-terminal and/or C-terminal His-tag and/or HQ-tag such as SEQ ID NO: 94; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 91. In another embodiment, the polypeptide comprises or consists of amino acids 1 to 544 of SEQ ID NO: 94. In an embodiment, the polypeptide has been isolated.

In a continuation of the thirty-third aspect, the invention relates to a GH5 polypeptide having xylanase activity encoded by a polynucleotide that hybridizes under high or very high stringency conditions with (i) the mature polypeptide coding sequence of SEQ ID NO: 89, (ii) the mature polypeptide coding sequence of SEQ ID NO: 92, or (iii) the full-length complement of (i) or (ii) (Sambrook et al., supra). In an embodiment, the polypeptide has been isolated.

In a continuation of the thirty-third aspect, the invention relates to a GH5 polypeptide having xylanase activity encoded by a polynucleotide having a sequence identity to the mature polypeptide coding sequence of SEQ ID NO: 89 or SEQ ID NO: 92 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-third aspect, the invention relates to variants of SEQ ID NO: 91 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 91 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 91 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 91 is not more than 10, e.g., 1, 2, 3, 4, 5, 6, 7, 8, 9 or 10. In another embodiment, the number of substitutions and/or deletions and/or insertions in SEQ ID NO: 91 is not more than 10, e.g., 1, 2, 3, 4, 5, 6, 7, 8, 9 or 10. In a further embodiment, the number of substitutions in SEQ ID NO: 91 is not more than 10, e.g., 1, 2, 3, 4, 5, 6, 7, 8, 9 or 10. In a further embodiment, the number of conservative substitutions in SEQ ID NO: 91 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Fourth Aspect

In a thirty-fourth aspect, the invention relates to polypeptides having a sequence identity to the mature polypeptide of SEQ ID NO: 96 at least 96%, e.g., at least 97%, at least 97.5%, at least 98%, at least 98.5%, at least 99%, at least 99.5%, or 100%, which have xylanase activity. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from the mature polypeptide of SEQ ID NO: 96.

In one embodiment, the polypeptide preferably comprises or consists of the amino acid sequence of SEQ ID NO: 96 or an allelic variant thereof; comprises the amino acid sequence of SEQ ID NO: 96 and a N-terminal and/or C-terminal His-tag and/or HQ-tag such as SEQ ID NO: 100 or the mature polypeptide of SEQ ID NO: 99; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 96. In another embodiment, the polypeptide comprises or consists of amino acids 1 to 536 of SEQ ID NO: 96. In another embodiment, the polypeptide comprises or consists of the mature polypeptide of SEQ ID NO: 99. In another embodiment, the polypeptide comprises or consists of amino acids 1 to 544 of SEQ ID NO: 99. In an embodiment, the polypeptide has been isolated.

In a continuation of the thirty-fourth aspect, the invention further relates to polypeptides having a sequence identity to SEQ ID NO: 97 of at least 96% which have xylanase activity. In an embodiment, the GH5 polypeptide has a sequence identity to SEQ ID NO: 97 of at least 96.5%. In an embodiment, the GH5 polypeptide has a sequence identity to SEQ ID NO: 97 of at least 97%. In an embodiment, the GH5 polypeptide has a sequence identity to SEQ ID NO: 97 of at least 97.5%. In an embodiment, the GH5 polypeptide has a sequence identity to SEQ ID NO: 97 of at least 98%. In an embodiment, the GH5 polypeptide has a sequence identity to SEQ ID NO: 97 of at least 98.5%. In an embodiment, the GH5 polypeptide has a sequence identity to SEQ ID NO: 97 of at least 99%. In an embodiment, the GH5 polypeptide has a sequence identity to SEQ ID NO: 97 of at least 99.5%. The polypeptides of the seventeenth aspect have at least 75%, preferably at least 90%, more preferably at least 95%, and most preferably at least 100% of the xylanase activity of SEQ ID NO: 97.

In one embodiment, the polypeptides differ by up to 50 amino acids, e.g., between 1 and 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 97. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 100.

In one embodiment, the polypeptide preferably comprises or consists of the amino acid sequence of SEQ ID NO: 97 or an allelic variant thereof; comprises the amino acid sequence of SEQ ID NO: 97 and a N-terminal and/or C-terminal His-tag and/or HQ-tag such as SEQ ID NO: 100; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 97. In another embodiment, the polypeptide comprises or consists of amino acids 1 to 544 of SEQ ID NO: 100. In an embodiment, the polypeptide has been isolated.

In a continuation of the thirty-fourth aspect, the invention relates to a GH5 polypeptide having xylanase activity encoded by a polynucleotide that hybridizes under high or very high stringency conditions with (i) the mature polypeptide coding sequence of SEQ ID NO: 95, (ii) the mature polypeptide coding sequence of SEQ ID NO: 98, or (iii) the full-length complement of (i) or (ii) (Sambrook et al., supra). In an embodiment, the polypeptide has been isolated.

In a continuation of the thirty-fourth aspect, the invention relates to a GH5 polypeptide having xylanase activity encoded by a polynucleotide having a sequence identity to the mature polypeptide coding sequence of SEQ ID NO: 95 or SEQ ID NO: 98 or the cDNA sequence thereof of at least 96%, e.g., at least 97%, at least 97.5%, at least 98%, at least 98.5%, at least 99%, at least 99.5%, or 100%. In a further embodiment, the polypeptide has been isolated.

In a continuation of the thirty-fourth aspect, the invention relates to variants of SEQ ID NO: 97 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 97 is not more than 50, e.g., 1, 2, 3, 4, 5, 6, 7, 8, 9, 10, 11, 12, 13, 14, 15, 16, 17, 18, 19, 20 or 21. In another embodiment, the number of positions comprising one or more amino acid substitutions, and/or one or more amino acid deletions, and/or one or more amino acid insertions or any combination thereof in SEQ ID NO: 97 is between 1 and 21, such as 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 97 is not more than 10, e.g., 1, 2, 3, 4, 5, 6, 7, 8, 9 or 10. In another embodiment, the number of substitutions and/or deletions and/or insertions in SEQ ID NO: 97 is not more than 10, e.g., 1, 2, 3, 4, 5, 6, 7, 8, 9 or 10. In a further embodiment, the number of substitutions in SEQ ID NO: 97 is not more than 10, e.g., 1, 2, 3, 4, 5, 6, 7, 8, 9 or 10. In a further embodiment, the number of conservative substitutions in SEQ ID NO: 97 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Fifth Aspect

In a thirty-fifth aspect, the invention relates to polypeptides having a sequence identity to the mature polypeptide of SEQ ID NO: 102 at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 102.

In one embodiment, the polypeptide preferably comprises or consists of the amino acid sequence of SEQ ID NO: 102 or an allelic variant thereof; comprises the amino acid sequence of SEQ ID NO: 102 and a N-terminal and/or C-terminal His-tag and/or HQ-tag such as SEQ ID NO: 106 or the mature polypeptide of SEQ ID NO: 105; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 102. In another embodiment, the polypeptide comprises or consists of amino acids 1 to 536 of SEQ ID NO: 102. In another embodiment, the polypeptide comprises or consists of the mature polypeptide of SEQ ID NO: 105. In another embodiment, the polypeptide comprises or consists of amino acids 1 to 544 of SEQ ID NO: 105. In an embodiment, the polypeptide has been isolated.

In a continuation of the thirty-fifth aspect, the invention further relates to polypeptides having a sequence identity to SEQ ID NO: 103 of at least 85% which have xylanase activity. In an embodiment, the GH5 polypeptide has a sequence identity to SEQ ID NO: 103 of at least 86%. In an embodiment, the GH5 polypeptide has a sequence identity to SEQ ID NO: 103 of at least 87%. In an embodiment, the GH5 polypeptide has a sequence identity to SEQ ID NO: 103 of at least 88%. In an embodiment, the GH5 polypeptide has a sequence identity to SEQ ID NO: 103 of at least 89%. In an embodiment, the GH5 polypeptide has a sequence identity to SEQ ID NO: 103 of at least 90%. In an embodiment, the GH5 polypeptide has a sequence identity to SEQ ID NO: 103 of at least 91%. In an embodiment, the GH5 polypeptide has a sequence identity to SEQ ID NO: 103 of at least 92%. In an embodiment, the GH5 polypeptide has a sequence identity to SEQ ID NO: 103 of at least 93%. In an embodiment, the GH5 polypeptide has a sequence identity to SEQ ID NO: 103 of at least 94%. In an embodiment, the GH5 polypeptide has a sequence identity to SEQ ID NO: 103 of at least 95%. In an embodiment, the GH5 polypeptide has a sequence identity to SEQ ID NO: 103 of at least 96%. In an embodiment, the GH5 polypeptide has a sequence identity to SEQ ID NO: 103 of at least 97%. In an embodiment, the GH5 polypeptide has a sequence identity to SEQ ID NO: 103 of at least 98%. In an embodiment, the GH5 polypeptide has a sequence identity to SEQ ID NO: 103 of at least 99%. The polypeptides of the seventeenth aspect have at least 75%, preferably at least 90%, more preferably at least 95%, and most preferably at least 100% of the xylanase activity of SEQ ID NO: 103.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 103. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 106.

In one embodiment, the polypeptide preferably comprises or consists of the amino acid sequence of SEQ ID NO: 103 or an allelic variant thereof; comprises the amino acid sequence of SEQ ID NO: 103 and a N-terminal and/or C-terminal His-tag and/or HQ-tag such as SEQ ID NO: 106; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 103. In another embodiment, the polypeptide comprises or consists of amino acids 1 to 544 of SEQ ID NO: 106. In an embodiment, the polypeptide has been isolated.

In a continuation of the thirty-fifth aspect, the invention relates to a GH5 polypeptide having xylanase activity encoded by a polynucleotide that hybridizes under high or very high stringency conditions with (i) the mature polypeptide coding sequence of SEQ ID NO: 101, (ii) the mature polypeptide coding sequence of SEQ ID NO: 104, or (iii) the full-length complement of (i) or (ii) (Sambrook et al., supra). In an embodiment, the polypeptide has been isolated.

In a continuation of the thirty-fifth aspect, the invention relates to a GH5 polypeptide having xylanase activity encoded by a polynucleotide having a sequence identity to the mature polypeptide coding sequence of SEQ ID NO: 101 or SEQ ID NO: 104 or the cDNA sequence thereof of at least 85%, e.g., at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-fifth aspect, the invention relates to variants of SEQ ID NO: 103 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 103 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 103 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 103 is not more than 10, e.g., 1, 2, 3, 4, 5, 6, 7, 8, 9 or 10. In another embodiment, the number of substitutions and/or deletions and/or insertions in SEQ ID NO: 103 is not more than 10, e.g., 1, 2, 3, 4, 5, 6, 7, 8, 9 or 10. In a further embodiment, the number of substitutions in SEQ ID NO: 103 is not more than 10, e.g., 1, 2, 3, 4, 5, 6, 7, 8, 9 or 10. In a further embodiment, the number of conservative substitutions in SEQ ID NO: 103 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Sixth Aspect

In a thirty-sixth aspect, the invention relates to polypeptides having a sequence identity to the mature polypeptide of SEQ ID NO: 108 at least 82%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 108.

In one embodiment, the polypeptide preferably comprises or consists of the amino acid sequence of SEQ ID NO: 108 or an allelic variant thereof; comprises the amino acid sequence of SEQ ID NO: 108 and a N-terminal and/or C-terminal His-tag and/or HQ-tag such as SEQ ID NO: 112 or the mature polypeptide of SEQ ID NO: 111; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 108. In another embodiment, the polypeptide comprises or consists of amino acids 1 to 536 of SEQ ID NO: 108. In another embodiment, the polypeptide comprises or consists of the mature polypeptide of SEQ ID NO: 111. In another embodiment, the polypeptide comprises or consists of amino acids 1 to 544 of SEQ ID NO: 111. In an embodiment, the polypeptide has been isolated.

In a continuation of the thirty-sixth aspect, the invention further relates to polypeptides having a sequence identity to SEQ ID NO: 109 of at least 82% which have xylanase activity. In an embodiment, the GH5 polypeptide has a sequence identity to SEQ ID NO: 109 of at least 85%. In an embodiment, the GH5 polypeptide has a sequence identity to SEQ ID NO: 109 of at least 86%. In an embodiment, the GH5 polypeptide has a sequence identity to SEQ ID NO: 109 of at least 87%. In an embodiment, the GH5 polypeptide has a sequence identity to SEQ ID NO: 109 of at least 88%. In an embodiment, the GH5 polypeptide has a sequence identity to SEQ ID NO: 109 of at least 89%. In an embodiment, the GH5 polypeptide has a sequence identity to SEQ ID NO: 109 of at least 90%. In an embodiment, the GH5 polypeptide has a sequence identity to SEQ ID NO: 109 of at least 91%. In an embodiment, the GH5 polypeptide has a sequence identity to SEQ ID NO: 109 of at least 92%. In an embodiment, the GH5 polypeptide has a sequence identity to SEQ ID NO: 109 of at least 93%. In an embodiment, the GH5 polypeptide has a sequence identity to SEQ ID NO: 109 of at least 94%. In an embodiment, the GH5 polypeptide has a sequence identity to SEQ ID NO: 109 of at least 95%. In an embodiment, the GH5 polypeptide has a sequence identity to SEQ ID NO: 109 of at least 96%. In an embodiment, the GH5 polypeptide has a sequence identity to SEQ ID NO: 109 of at least 97%. In an embodiment, the GH5 polypeptide has a sequence identity to SEQ ID NO: 109 of at least 98%. In an embodiment, the GH5 polypeptide has a sequence identity to SEQ ID NO: 109 of at least 99%. The polypeptides of the seventeenth aspect have at least 75%, preferably at least 90%, more preferably at least 95%, and most preferably at least 100% of the xylanase activity of SEQ ID NO: 109.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 109. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 112.

In one embodiment, the polypeptide preferably comprises or consists of the amino acid sequence of SEQ ID NO: 109 or an allelic variant thereof; comprises the amino acid sequence of SEQ ID NO: 109 and a N-terminal and/or C-terminal His-tag and/or HQ-tag such as SEQ ID NO: 112; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 109. In another embodiment, the polypeptide comprises or consists of amino acids 1 to 544 of SEQ ID NO: 112. In an embodiment, the polypeptide has been isolated.

In a continuation of the thirty-sixth aspect, the invention relates to a GH5 polypeptide having xylanase activity encoded by a polynucleotide that hybridizes under high or very high stringency conditions with (i) the mature polypeptide coding sequence of SEQ ID NO: 107, (ii) the mature polypeptide coding sequence of SEQ ID NO: 110, or (iii) the full-length complement of (i) or (ii) (Sambrook et al., supra). In an embodiment, the polypeptide has been isolated.

In a continuation of the thirty-sixth aspect, the invention relates to a GH5 polypeptide having xylanase activity encoded by a polynucleotide having a sequence identity to the mature polypeptide coding sequence of SEQ ID NO: 107 or SEQ ID NO: 110 or the cDNA sequence thereof of at least 82%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-sixth aspect, the invention relates to variants of SEQ ID NO: 109 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 109 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 109 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 109 is not more than 10, e.g., 1, 2, 3, 4, 5, 6, 7, 8, 9 or 10. In another embodiment, the number of substitutions and/or deletions and/or insertions in SEQ ID NO: 109 is not more than 10, e.g., 1, 2, 3, 4, 5, 6, 7, 8, 9 or 10. In a further embodiment, the number of substitutions in SEQ ID NO: 109 is not more than 10, e.g., 1, 2, 3, 4, 5, 6, 7, 8, 9 or 10. In a further embodiment, the number of conservative substitutions in SEQ ID NO: 109 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Seventh Aspect

In a thirty-seventh aspect, the invention relates to polypeptides having a sequence identity to the mature polypeptide of SEQ ID NO: 114 at least 96%, e.g., at least 97%, at least 97.5%, at least 98%, at least 98.5%, at least 99%, at least 99.5%, or 100%, which have xylanase activity. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from the mature polypeptide of SEQ ID NO: 114.

In one embodiment, the polypeptide preferably comprises or consists of the amino acid sequence of SEQ ID NO: 114 or an allelic variant thereof; comprises the amino acid sequence of SEQ ID NO: 114 and a N-terminal and/or C-terminal His-tag and/or HQ-tag such as SEQ ID NO: 118 or the mature polypeptide of SEQ ID NO: 117; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 114. In another embodiment, the polypeptide comprises or consists of amino acids 1 to 538 of SEQ ID NO: 114. In another embodiment, the polypeptide comprises or consists of the mature polypeptide of SEQ ID NO: 117. In another embodiment, the polypeptide comprises or consists of amino acids 1 to 546 of SEQ ID NO: 117. In an embodiment, the polypeptide has been isolated.

In a continuation of the thirty-seventh aspect, the invention further relates to polypeptides having a sequence identity to SEQ ID NO: 115 of at least 96% which have xylanase activity. In an embodiment, the GH5 polypeptide has a sequence identity to SEQ ID NO: 115 of at least 96.5%. In an embodiment, the GH5 polypeptide has a sequence identity to SEQ ID NO: 115 of at least 97%. In an embodiment, the GH5 polypeptide has a sequence identity to SEQ ID NO: 115 of at least 97.5%. In an embodiment, the GH5 polypeptide has a sequence identity to SEQ ID NO: 115 of at least 98%. In an embodiment, the GH5 polypeptide has a sequence identity to SEQ ID NO: 115 of at least 98.5%. In an embodiment, the GH5 polypeptide has a sequence identity to SEQ ID NO: 115 of at least 99%. In an embodiment, the GH5 polypeptide has a sequence identity to SEQ ID NO: 115 of at least 99.5%. The polypeptides of the seventeenth aspect have at least 75%, preferably at least 90%, more preferably at least 95%, and most preferably at least 100% of the xylanase activity of SEQ ID NO: 115.

In one embodiment, the polypeptides differ by up to 50 amino acids, e.g., between 1 and 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 115. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 118.

In one embodiment, the polypeptide preferably comprises or consists of the amino acid sequence of SEQ ID NO: 115 or an allelic variant thereof; comprises the amino acid sequence of SEQ ID NO: 115 and a N-terminal and/or C-terminal His-tag and/or HQ-tag such as SEQ ID NO: 118; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 538 of SEQ ID NO: 115. In another embodiment, the polypeptide comprises or consists of amino acids 1 to 546 of SEQ ID NO: 118. In an embodiment, the polypeptide has been isolated.

In a continuation of the thirty-seventh aspect, the invention relates to a GH5 polypeptide having xylanase activity encoded by a polynucleotide that hybridizes under high or very high stringency conditions with (i) the mature polypeptide coding sequence of SEQ ID NO: 113, (ii) the mature polypeptide coding sequence of SEQ ID NO: 116, or (iii) the full-length complement of (i) or (ii) (Sambrook et al., supra). In an embodiment, the polypeptide has been isolated.

In a continuation of the thirty-seventh aspect, the invention relates to a GH5 polypeptide having xylanase activity encoded by a polynucleotide having a sequence identity to the mature polypeptide coding sequence of SEQ ID NO: 113 or SEQ ID NO: 116 or the cDNA sequence thereof of at least 96%, e.g., at least 97%, at least 97.5%, at least 98%, at least 98.5%, at least 99%, at least 99.5%, or 100%. In a further embodiment, the polypeptide has been isolated.

In a continuation of the thirty-seventh aspect, the invention relates to variants of SEQ ID NO: 115 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 115 is not more than 21, e.g., 1, 2, 3, 4, 5, 6, 7, 8, 9, 10, 11, 12, 13, 14, 15, 16, 17, 18, 19, 20 or 21. In another embodiment, the number of positions comprising one or more amino acid substitutions, and/or one or more amino acid deletions, and/or one or more amino acid insertions or any combination thereof in SEQ ID NO: 115 is between 1 and 21, such as 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 115 is not more than 10, e.g., 1, 2, 3, 4, 5, 6, 7, 8, 9 or 10. In another embodiment, the number of substitutions and/or deletions and/or insertions in SEQ ID NO: 115 is not more than 10, e.g., 1, 2, 3, 4, 5, 6, 7, 8, 9 or 10. In a further embodiment, the number of substitutions in SEQ ID NO: 115 is not more than 10, e.g., 1, 2, 3, 4, 5, 6, 7, 8, 9 or 10. In a further embodiment, the number of conservative substitutions in SEQ ID NO: 115 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Eighth Aspect

In a thirty-eighth aspect, the invention relates to polypeptides having a sequence identity to the mature polypeptide of SEQ ID NO: 120 at least 96%, e.g., at least 97%, at least 97.5%, at least 98%, at least 98.5%, at least 99%, at least 99.5%, or 100%, which have xylanase activity. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from the mature polypeptide of SEQ ID NO: 120.

In one embodiment, the polypeptide preferably comprises or consists of the amino acid sequence of SEQ ID NO: 120 or an allelic variant thereof; comprises the amino acid sequence of SEQ ID NO: 120 and a N-terminal and/or C-terminal His-tag and/or HQ-tag such as SEQ ID NO: 124 or the mature polypeptide of SEQ ID NO: 123; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 120. In another embodiment, the polypeptide comprises or consists of amino acids 1 to 537 of SEQ ID NO: 120. In another embodiment, the polypeptide comprises or consists of the mature polypeptide of SEQ ID NO: 123. In another embodiment, the polypeptide comprises or consists of amino acids 1 to 545 of SEQ ID NO: 123. In an embodiment, the polypeptide has been isolated.

In a continuation of the thirty-eighth aspect, the invention further relates to polypeptides having a sequence identity to SEQ ID NO: 121 of at least 96% which have xylanase activity. In an embodiment, the GH5 polypeptide has a sequence identity to SEQ ID NO: 121 of at least 96.5%. In an embodiment, the GH5 polypeptide has a sequence identity to SEQ ID NO: 121 of at least 97%. In an embodiment, the GH5 polypeptide has a sequence identity to SEQ ID NO: 121 of at least 97.5%. In an embodiment, the GH5 polypeptide has a sequence identity to SEQ ID NO: 121 of at least 98%. In an embodiment, the GH5 polypeptide has a sequence identity to SEQ ID NO: 121 of at least 98.5%. In an embodiment, the GH5 polypeptide has a sequence identity to SEQ ID NO: 121 of at least 99%. In an embodiment, the GH5 polypeptide has a sequence identity to SEQ ID NO: 121 of at least 99.5%. The polypeptides of the seventeenth aspect have at least 75%, preferably at least 90%, more preferably at least 95%, and most preferably at least 100% of the xylanase activity of SEQ ID NO: 121.

In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 121. In one embodiment, the polypeptides differ by up to 21 amino acids, e.g., between 1 and 21 amino acids, such as 1-20, 1-15, 1-10 or 1-5 amino acids, or 1, 2, 3, 4, 5, 6, 7, 8, 9, 10, 11, 12, 13, 14, 15, 16, 17, 18, 19, 20 or 21 amino acids from SEQ ID NO: 124.

In one embodiment, the polypeptide preferably comprises or consists of the amino acid sequence of SEQ ID NO: 121 or an allelic variant thereof; comprises the amino acid sequence of SEQ ID NO: 121 and a N-terminal and/or C-terminal His-tag and/or HQ-tag such as SEQ ID NO: 124; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 537 of SEQ ID NO: 121. In another embodiment, the polypeptide comprises or consists of amino acids 1 to 545 of SEQ ID NO: 124. In an embodiment, the polypeptide has been isolated.

In a continuation of the thirty-eighth aspect, the invention relates to a GH5 polypeptide having xylanase activity encoded by a polynucleotide that hybridizes under high or very high stringency conditions with (i) the mature polypeptide coding sequence of SEQ ID NO: 119, (ii) the mature polypeptide coding sequence of SEQ ID NO: 122, or (iii) the full-length complement of (i) or (ii) (Sambrook et al., supra). In an embodiment, the polypeptide has been isolated.

In a continuation of the thirty-eighth aspect, the invention relates to a GH5 polypeptide having xylanase activity encoded by a polynucleotide having a sequence identity to the mature polypeptide coding sequence of SEQ ID NO: 119 or SEQ ID NO: 122 or the cDNA sequence thereof of at least 96%, e.g., at least 97%, at least 97.5%, at least 98%, at least 98.5%, at least 99%, at least 99.5%, or 100%. In a further embodiment, the polypeptide has been isolated.

In a continuation of the thirty-eighth aspect, the invention relates to variants of SEQ ID NO: 121 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 121 is not more than 21, e.g., 1, 2, 3, 4, 5, 6, 7, 8, 9, 10, 11, 12, 13, 14, 15, 16, 17, 18, 19, 20 or 21. In another embodiment, the number of positions comprising one or more amino acid substitutions, and/or one or more amino acid deletions, and/or one or more amino acid insertions or any combination thereof in SEQ ID NO: 121 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 121 is not more than 10, e.g., 1, 2, 3, 4, 5, 6, 7, 8, 9 or 10. In another embodiment, the number of substitutions and/or deletions and/or insertions in SEQ ID NO: 121 is not more than 10, e.g., 1, 2, 3, 4, 5, 6, 7, 8, 9 or 10. In a further embodiment, the number of substitutions in SEQ ID NO: 121 is not more than 10, e.g., 1, 2, 3, 4, 5, 6, 7, 8, 9 or 10. In a further embodiment, the number of conservative substitutions in SEQ ID NO: 121 is not more than 10, e.g., 1, 2, 3, 4, 5, 6, 7, 8, 9 or 10. Examples of amino acid changes, conservative substitutions and fusion peptides are described in the fourth aspect of the invention.

Thirty-Nineth Aspect

In a thirty-ninth aspect, the invention relates to polypeptides having a sequence identity to the mature polypeptide of SEQ ID NO: 126 at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%, which have xylanase activity. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from the mature polypeptide of SEQ ID NO: 126.

In one embodiment, the polypeptide preferably comprises or consists of the amino acid sequence of SEQ ID NO: 126 or an allelic variant thereof; comprises the amino acid sequence of SEQ ID NO: 126 and a N-terminal and/or C-terminal His-tag and/or HQ-tag such as SEQ ID NO: 130 or the mature polypeptide of SEQ ID NO: 129; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of the mature polypeptide of SEQ ID NO: 126. In another embodiment, the polypeptide comprises or consists of amino acids 1 to 536 of SEQ ID NO: 126. In another embodiment, the polypeptide comprises or consists of the mature polypeptide of SEQ ID NO: 129. In another embodiment, the polypeptide comprises or consists of amino acids 1 to 544 of SEQ ID NO: 129. In an embodiment, the polypeptide has been isolated.

In a continuation of the thirty-ninth aspect, the invention further relates to polypeptides having a sequence identity to SEQ ID NO: 127 of at least 80% which have xylanase activity. In an embodiment, the GH5 polypeptide has a sequence identity to SEQ ID NO: 127 of at least 85%. In an embodiment, the GH5 polypeptide has a sequence identity to SEQ ID NO: 127 of at least 86%. In an embodiment, the GH5 polypeptide has a sequence identity to SEQ ID NO: 127 of at least 87%. In an embodiment, the GH5 polypeptide has a sequence identity to SEQ ID NO: 127 of at least 88%. In an embodiment, the GH5 polypeptide has a sequence identity to SEQ ID NO: 127 of at least 89%. In an embodiment, the GH5 polypeptide has a sequence identity to SEQ ID NO: 127 of at least 90%. In an embodiment, the GH5 polypeptide has a sequence identity to SEQ ID NO: 127 of at least 91%. In an embodiment, the GH5 polypeptide has a sequence identity to SEQ ID NO: 127 of at least 92%. In an embodiment, the GH5 polypeptide has a sequence identity to SEQ ID NO: 127 of at least 93%. In an embodiment, the GH5 polypeptide has a sequence identity to SEQ ID NO: 127 of at least 94%. In an embodiment, the GH5 polypeptide has a sequence identity to SEQ ID NO: 127 of at least 95%. In an embodiment, the GH5 polypeptide has a sequence identity to SEQ ID NO: 127 of at least 96%. In an embodiment, the GH5 polypeptide has a sequence identity to SEQ ID NO: 127 of at least 97%. In an embodiment, the GH5 polypeptide has a sequence identity to SEQ ID NO: 127 of at least 98%. In an embodiment, the GH5 polypeptide has a sequence identity to SEQ ID NO: 127 of at least 99%. The polypeptides of the seventeenth aspect have at least 75%, preferably at least 90%, more preferably at least 95%, and most preferably at least 100% of the xylanase activity of SEQ ID NO: 127.

In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 127. In one embodiment, the polypeptides differ by up to 50 amino acids, e.g., between 1 and 50 amino acids, such as 1-45, 1-40, 1-35, 1-30, 1-25, 1-20, 1-15, 1-10 or 1-5 amino acids, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids from SEQ ID NO: 130.

In one embodiment, the polypeptide preferably comprises or consists of the amino acid sequence of SEQ ID NO: 127 or an allelic variant thereof; comprises the amino acid sequence of SEQ ID NO: 127 and a N-terminal and/or C-terminal His-tag and/or HQ-tag such as SEQ ID NO: 130; or is a fragment thereof having xylanase activity and having at least 90% such as at least 91%, at least 92%, at least 93%, at least 94%, at least 95%, at least 96%, at least 97%, at least 98% or at least 99% of the length of the mature polypeptide. In another embodiment, the polypeptide comprises or consists of amino acids 1 to 536 of SEQ ID NO: 127. In another embodiment, the polypeptide comprises or consists of amino acids 1 to 544 of SEQ ID NO: 130. In an embodiment, the polypeptide has been isolated.

In a continuation of the thirty-ninth aspect, the invention relates to a GH5 polypeptide having xylanase activity encoded by a polynucleotide that hybridizes under high or very high stringency conditions with (i) the mature polypeptide coding sequence of SEQ ID NO: 125, (ii) the mature polypeptide coding sequence of SEQ ID NO: 128, or (iii) the full-length complement of (i) or (ii) (Sambrook et al., supra). In an embodiment, the polypeptide has been isolated.

In a continuation of the thirty-ninth aspect, the invention relates to a GH5 polypeptide having xylanase activity encoded by a polynucleotide having a sequence identity to the mature polypeptide coding sequence of SEQ ID NO: 125 or SEQ ID NO: 128 or the cDNA sequence thereof of at least 80%, e.g., at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100%. In a further embodiment, the polypeptide has been isolated.

In a continuation of the thirty-ninth aspect, the invention relates to variants of SEQ ID NO: 127 having xylanase activity comprising one or more amino acid substitutions, and/or one or more amino acid deletions, and/or one or more amino acid insertions or any combination thereof at one or more (e.g., several) positions. In an embodiment, the number of positions comprising one or more amino acid substitutions, and/or one or more amino acid deletions, and/or one or more amino acid insertions or any combination thereof in SEQ ID NO: 127 is not more than 50, e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50. In another embodiment, the number of positions comprising one or more amino acid substitutions, and/or one or more amino acid deletions, and/or one or more amino acid insertions or any combination thereof in SEQ ID NO: 127 is between 1 and 45, such as 1-40, 1-35, 1-30, 1-25, 1-20, 1-15, 1-10 or 1-5 positions. In an embodiment, the number of positions comprising one or more amino acid substitutions, and/or one or more amino acid deletions, and/or one or more amino acid insertions or any combination thereof in SEQ ID NO: 127 is not more than 10, e.g., 1, 2, 3, 4, 5, 6, 7, 8, 9 or 10. In another embodiment, the number of substitutions and/or deletions and/or insertions in SEQ ID NO: 127 is not more than 10, e.g., 1, 2, 3, 4, 5, 6, 7, 8, 9 or 10. In a further embodiment, the number of substitutions in SEQ ID NO: 127 is not more than 10, e.g., 1, 2, 3, 4, 5, 6, 7, 8, 9 or 10. In a further embodiment, the number of conservative substitutions in SEQ ID NO: 127 is not more than 10, e.g., 1, 2, 3, 4, 5, 6, 7, 8, 9 or 10. Examples of amino acid changes, conservative substitutions and fusion peptides are described in the fourth aspect of the invention.

Polypeptides Releasing Xylose from Plant Based Material from the Sub-Family Panicoideae In an embodiment, the GH5 polypeptide of the invention releases at least 3% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine of the invention. In an embodiment, the percentage solubilised xylose is at least 3.5%, such as at least 4%, at least 4.5%, at least 5% or at least 5.5%.

In a preferred embodiment, the GH5 polypeptide releases at least 6% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-two, twenty-four, twenty-five, twenty-seven, twenty-eight, thirty, thirty-one, thirty-two, thirty-three, thirty-four, thirty-five, thirty-six, thirty-eight and/or thirty-nine of the invention. In an embodiment, the percentage solubilised xylose is at least 6.5%, such as at least 7% or at least 7.5%.

In a more preferred embodiment, the GH5 polypeptide releases at least 8% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-five, twenty-seven, twenty-eight, thirty, thirty-three, thirty-four, thirty-five, thirty-six and/or thirty-nine of the invention.

In an embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif I: G[F/Y][A/S][V/G/A/I]HXY[P/V] (SEQ ID NO: 19) as described in the first aspect. In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif I, wherein motif I is G[F/Y][A/S]VH[C/D/I/W]YP (SEQ ID NO: 59). In a preferred embodiment, the GH5 polypeptide of any of aspects twenty-two, twenty-three, twenty-nine, thirty, thirty-two, thirty-four, thirty-five, thirty-seven and/or thirty-eight comprises one or more motif I, wherein motif I is GYAVH-WYP (SEQ ID NO: 60).

In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif I: G[F/Y][A/S][V/G/A/I]HXY[P/V] (SEQ ID NO: 19) and releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In an embodiment motif I is G[F/Y][A/S]VH[C/D/I/W]YP (SEQ ID NO: 59).

In an embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif II: [I/L/V][H/I/L/M/V][F/I/Y][D/E][I/L/V]XNEP (SEQ ID NO: 20) as described in the second aspect. In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif II, wherein motif II is [I/V][H/M][F/I]E[I/L][A/I/V]NEP (SEQ ID NO: 61). In a preferred embodiment, the GH5 polypeptide of any of aspects twenty-three, twenty-five, twenty-nine, thirty, thirty-one, thirty-three, thirty-four, thirty-five, thirty-six and/or thirty-nine comprises one or more motif II, wherein motif II is VMFE[I/L][A/I/V]NEP (SEQ ID NO: 62).

In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif II: [I/L/V][H/I/L/M/V][F/I/Y][D/E][I/L/V]XNEP (SEQ ID NO: 20) and releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In an embodiment motif II is [I/V][H/M][F/I]E[I/L][A/I/V]NEP (SEQ ID NO: 61).

In an embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif III: [D/G][A/T/W]XX[N/T]X[FILV]R[A/L/M][A/F/H][I/L/M] (SEQ ID NO: 21) as described in the third aspect. In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif III, wherein motif III is G[A/W][K/N/Y][C/L/M/S/V]N[L/Q/W/Y][FILV]RL[F/H][I/L/M] (SEQ ID NO: 63). In a preferred embodiment, the GH5 polypeptide of any of aspects twenty-two, twenty-three, twenty-nine, thirty-one, thirty-three, thirty-four, thirty-five, thirty-six, thirty-seven and/or thirty-eight comprises one or more motif III, wherein motif III is GWNMNQVRLFI (SEQ ID NO: 64).

In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more motif III: [D/G][A/T/W]XX[N/T]X[FILV]R[A/L/M][A/F/H][I/L/M] (SEQ ID NO: 21) and releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In an embodiment motif III is G[A/W][K/N/Y][C/L/M/S/V]N[L/Q/W/Y][FILV]RL[F/H][I/L/M] (SEQ ID NO: 63).

In an embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more of motif I: G[F/Y][A/S][V/G/A/I]HXY[P/V] (SEQ ID NO: 19) as described in the first aspect, one or more of motif II: [I/L/V][H/I/L/M/V][F/I/Y][D/E][I/L/V]XNEP (SEQ ID NO: 20) as described in the second aspect and one or more of motif III: [D/G][A/T/W]XX[N/T]X[FILV]R[A/L/M][A/F/H][I/L/M] (SEQ ID NO: 21) as described in the third aspect. In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more of motif I, wherein motif I is G[F/Y][A/S]VH[C/D/I/W]YP (SEQ ID NO: 59), one or more of motif II, wherein motif II is [I/V][H/M][F/I]E[I/L][A/I/V]NEP (SEQ ID NO: 61) and one or more motif III, wherein motif III is G[A/W][K/N/Y][C/L/M/S/V]N[L/Q/W/Y][FILV]RL[F/H][I/L/M] (SEQ ID NO: 63).

In a preferred embodiment, the GH5 polypeptide of any of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine comprises one or more of motif I: G[F/Y][A/S][V/G/A/I]HXY[P/V] (SEQ ID NO: 19) as described in the first aspect, one or more of motif II: [I/L/V][H/I/L/M/V][F/I/Y][D/E][I/L/V]XNEP (SEQ ID NO: 20) as described in the second aspect and one or more of motif III: [D/G][A/T/W]XX[N/T]X[FILV]R[A/L/M][A/F/H][I/L/M] (SEQ ID NO: 21) as described in the third aspect and releases at least 3% solubilized xylose from plant based material from the sub-family Panicoideae. In an embodiment, the percentage solubilised xylose is at least 3.5%, such as at least 4%, at least 4.5%, at least 5%, at least 5.5%, at least 6%, at least 6.5%, at least 7%, at least 7.5% or at least 8%. In an embodiment, the method is performed under the reaction conditions 10 mg GH5 polypeptide per kg DFDSM and incubation at 40° C., pH 5 for 4 hours. In an embodiment motif I is G[F/Y][A/S]VH[C/D/I/W]YP (SEQ ID NO: 59), motif II is [I/V][H/M][F/I]E[I/L][A/I/V]NEP (SEQ ID NO: 61) and motif III is G[A/W][K/N/Y][C/L/M/S/V]N[L/Q/W/Y][FILV]RL[F/H][I/L/M] (SEQ ID NO: 63).

Methods of Improving Animal Performance

In a fortieth aspect, the invention relates to a method of improving the performance of an animal comprising administering to the animal an animal feed or an animal feed additive comprising the GH5 polypeptide of the invention such that the plant based material from the sub-family Panicoideae is administered together or separately with the GH5 polypeptide having xylanase activity. In a further aspect, the invention relates to a method of improving the performance of an animal comprising administering to the animal plant based material from the sub-family Panicoideae together with the polypeptide of the invention or a composition comprising the polypeptide of the invention and a formulating agent, such that the plant based material from the sub-family Panicoideae is added together or separately with the GH5 polypeptide having xylanase activity.

In an embodiment, the GH5 polypeptide of the invention is one or more of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine. In a preferred embodiment, the GH5 polypeptide is SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76 SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 and/or SEQ ID NO: 130.

In one embodiment, 'improving the performance of an animal' means that there is an increase in body weight gain. In another embodiment, 'improving the performance of an animal' means that there is an improved feed conversion ratio. In a further embodiment, 'improving the performance of an animal' means that there is an increased feed efficiency. In a further embodiment, 'improving the performance of an animal' means that there is an increase in body weight gain and/or an improved feed conversion ratio and/or an increased feed efficiency.

Methods of Preparing an Animal Feed

In a forty-first aspect, the invention relates to a method of preparing an animal feed, comprising mixing the GH5 polypeptide of the invention with plant based material from the sub-family Panicoideae, such as maize, corn, *sorghum*, switchgrass, millet, pearl millet, foxtail millet or in a processed form such as milled corn, milled maize, defatted maize, defatted destarched maize, milled *sorghum*, milled switchgrass, milled millet, milled foxtail millet, milled pearl millet, or any combination thereof. In an embodiment, the GH5 polypeptide of the invention is one or more of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine.

In a preferred embodiment, the method of preparing an animal feed comprises mixing the GH5 polypeptide of SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76 SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 and/or SEQ ID NO: 130 with plant based material from the sub-family Panicoideae, such as maize, corn, *sorghum*, switchgrass, millet, pearl millet, foxtail millet or in a processed form such as milled corn, milled maize, defatted maize, defatted destarched maize, milled *sorghum*, milled switchgrass, milled millet, milled foxtail millet, milled pearl millet, or any combination thereof.

In a preferred embodiment, the plant based material from the sub-family Panicoideae is from the seed fraction (such as endosperm and/or husk) of the plant, preferable the seed fraction from maize, corn, *sorghum*, switchgrass, millet, pearl millet, foxtail millet or the processed from thereof, such as milled corn, milled maize, defatted maize, defatted destarched maize, milled *sorghum*, milled switchgrass, milled millet, milled foxtail millet, milled pearl millet, or any combination thereof. In another preferred embodiment, the plant based material from the sub-family Panicoideae is from a plant part comprising highly branched xylan, such as the seed fraction (such as endosperm and/or husk) of the plant.

Method for Improving the Nutritional Value of Animal Feed

The term improving the nutritional value of an animal feed means improving the availability of nutrients in the feed. The nutritional values refers in particular to improving the solubilisation and degradation of the arabinoxylan-containing fraction (e.g. such as hemicellulose) of the feed, thereby leading to increased release of nutrients from cells in the endosperm that have cell walls composed of highly recalcitrant hemicellulose. Consequently, an improved arabinose and/or xylose extraction indicates a disruption of the cell walls and as a result the nutritional value of the feed is improved resulting in increased growth rate and/or weight gain and/or feed conversion (i.e. the weight of ingested feed relative to weight gain). In addition the arabinose and/or xylose release may result in improved utilization of these components per se either directly or by bacterial fermentation in the hind gut thereby resulting in a production of short chain fatty acids that may be readily absorbed in the hind and utilised in the energy metabolism.

Thus in a forty-second aspect, the invention relates to a method for improving the nutritional value of an animal feed comprising treating the animal feed comprising plant based material from the sub-family Panicoideae with the GH5 polypeptide of the invention. In an embodiment, the GH5 polypeptide of the invention is one or more of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine. In an embodiment, the animal feed will have improved nutrient digestibility.

In a preferred embodiment, the method for improving the nutritional value of an animal feed comprises treating an animal feed comprising plant based material from the sub-family Panicoideae with the GH5 polypeptide of SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76 SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 and/or SEQ ID NO: 130. In an embodiment, the animal feed will have improved nutrient digestibility.

In a preferred embodiment, the plant based material from the sub-family Panicoideae is from the seed fraction (such as endosperm and/or husk) of the plant, preferable the seed fraction from maize, corn, *sorghum*, switchgrass, millet, pearl millet, foxtail millet or the processed from thereof, such as milled corn, milled maize, defatted maize, defatted destarched maize, milled *sorghum*, milled switchgrass, milled millet, milled foxtail millet, milled pearl millet, or any combination thereof. In another preferred embodiment, the plant based material from the sub-family Panicoideae is from a plant part comprising highly branched xylan, such as the seed fraction (such as endosperm and/or husk) of the plant.

Methods of Releasing Starch

In a forty-third aspect, the invention relates to a method of releasing starch from plant based material, comprising treating plant based material from the sub-family Panicoideae with the GH5 polypeptide of the invention. In an embodiment, the GH5 polypeptide of the invention is one or more of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine.

In a preferred embodiment, the method of releasing starch from plant based material comprises treating the animal feed comprising plant based material from the sub-family Panicoideae with the GH5 polypeptide of SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76 SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 and/or SEQ ID NO: 130.

In a preferred embodiment, the plant based material from the sub-family Panicoideae is from the seed fraction (such as endosperm and/or husk) of the plant, preferable the seed fraction from maize, corn, *sorghum*, switchgrass, millet, pearl millet, foxtail millet or the processed from thereof, such as milled corn, milled maize, defatted maize, defatted destarched maize, milled *sorghum*, milled switchgrass, milled millet, milled foxtail millet, milled pearl millet, or any combination thereof. In another preferred embodiment, the plant based material from the sub-family Panicoideae is from a plant part comprising highly branched xylan, such as the seed fraction (such as endosperm and/or husk) of the plant.

Sources of Polypeptides Having Xylanase Activity

A polypeptide having xylanase activity of the present invention may be obtained from microorganisms of any genus. For purposes of the present invention, the term "obtained from" as used herein in connection with a given source shall mean that the polypeptide encoded by a polynucleotide is produced by the source or by a strain in which the polynucleotide from the source has been inserted. In one aspect, the polypeptide obtained from a given source is secreted extracellularly.

The polypeptide may be a bacterial polypeptide. For example, the polypeptide may be a Gram-positive bacterial polypeptide such as a *Bacillus, Clostridium, Enterococcus, Geobacillus, Lactobacillus, Lactococcus, Oceanobacillus, Staphylococcus, Streptococcus,* or *Streptomyces* polypeptide having xylanase activity. In one embodiment, the polypeptide is from a bacterium of the class Bacilli, such as from the order Bacillales, or from the family Paenibacillaceae, or from the genus *Paenibacillus* or from the species *Paenibacillus illinoisensis, Paenibacillus campinasensis, Paenibacillus favisporus, Paenibacillus tundra, Paenibacillus xylanexedens, Paenibacillus chitinolyticus, Paenibacillus* sp-18054, *Paenibacillus* sp-62250, *Paenibacillus* sp-62603, *Paenibacillus* sp-19179, *Paenibacillus* sp-62332 or *Paenibacillus* sp-62248.

In another embodiment, the polypeptide is from a bacterium of the class Flavobacteriia, such as from the order Flavobacteriales, or from the family Flavobacteriaceae, or from the genus *Chryseobacterium* or from the species *Chryseobacterium* sp-10696.

Alternatively, the polypeptide may be from a metagenome, such as elephant dung metagenome or compose metagenome.

It will be understood that for the aforementioned species, the invention encompasses both the perfect and imperfect states, and other taxonomic equivalents, e.g., anamorphs, regardless of the species name by which they are known. Those skilled in the art will readily recognize the identity of appropriate equivalents.

Strains of these species are readily accessible to the public in a number of culture collections, such as the American Type Culture Collection (ATCC), Deutsche Sammlung von Mikroorganismen and Zellkulturen GmbH (DSMZ), Centraalbureau Voor Schimmelcultures (CBS), and Agricultural Research Service Patent Culture Collection, Northern Regional Research Center (NRRL).

The polypeptide may be identified and obtained from other sources including microorganisms isolated from nature (e.g., soil, composts, water, etc.) or DNA samples obtained directly from natural materials (e.g., soil, composts, water, etc.) using the above-mentioned probes. Techniques for isolating microorganisms and DNA directly from natural habitats are well known in the art. A polynucleotide encoding the polypeptide may then be obtained by similarly screening a genomic DNA or cDNA library of another microorganism or mixed DNA sample. Once a polynucleotide encoding a polypeptide has been detected with the probe(s), the polynucleotide can be isolated or cloned by utilizing techniques that are known to those of ordinary skill in the art (see, e.g., Sambrook et al., 1989, supra).

Polynucleotides

The present invention also relates to isolated polynucleotides encoding a polypeptide of the present invention.

The techniques used to isolate or clone a polynucleotide are known in the art and include isolation from genomic DNA or cDNA, or a combination thereof. The cloning of the polynucleotides from genomic DNA can be effected, e.g., by using the well-known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligation activated transcription (LAT) and polynucleotide-based amplification (NASBA) may be used. The polynucleotides may be cloned from a strain of *Paenibacillus* or *Chryseobacterium*, or a related organism and thus, for example, may be an allelic or species variant of the polypeptide encoding region of the polynucleotide.

Modification of a polynucleotide encoding a polypeptide of the present invention may be necessary for synthesizing polypeptides substantially similar to the polypeptide. The term "substantially similar" to the polypeptide refers to non-naturally occurring forms of the polypeptide.

Nucleic Acid Constructs

The present invention also relates to nucleic acid constructs comprising a polynucleotide of the present invention operably linked to one or more control sequences that direct the expression of the coding sequence in a suitable host cell under conditions compatible with the control sequences.

The polynucleotide may be manipulated in a variety of ways to provide for expression of the polypeptide. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide that is recognized by a host cell for expression of a polynucleotide encoding a polypeptide of the present invention. The promoter contains transcriptional control sequences that mediate the expression of the polypeptide. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a bacterial host cell are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *Bacillus thuringiensis* cryIIIA gene (Agaisse and Lereclus, 1994, *Molecular Microbiology* 13: 97-107), *E. coli* lac operon, *E. coli* trc promoter (Egon et al., 1988, *Gene* 69: 301-315), *Streptomyces coelicolor* agarase gene (dagA), and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in Gilbert et al., 1980, *Scientific American* 242: 74-94; and in Sambrook et al., 1989, supra. Examples of tandem promoters are disclosed in WO 99/43835.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* glucoamylase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Dania (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase V, *Trichoderma reesei* xylanase I, *Trichoderma reesei* xylanase II, *Trichoderma reesei* xylanase III, *Trichoderma reesei* beta-xylosidase, and *Trichoderma reesei* translation elongation factor, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof. Other promoters are described in U.S. Pat. No. 6,011,147.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator is operably linked to the 3'-terminus of the polynucleotide encoding the polypeptide. Any terminator that is functional in the host cell may be used in the present invention.

Preferred terminators for bacterial host cells are obtained from the genes for *Bacillus clausii* alkaline protease (aprH), *Bacillus licheniformis* alpha-amylase (amyL), and *Escherichia coli* ribosomal RNA (rrnB).

Preferred terminators for filamentous fungal host cells are obtained from the genes for *Aspergillus nidulans* acetamidase, *Aspergillus nidulans* anthranilate synthase, *Aspergillus niger* glucoamylase, *Aspergillus niger* alpha-glucosidase, *Aspergillus oryzae* TAKA amylase, *Fusarium oxysporum* trypsin-like protease, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase V, *Trichoderma reesei* xylanase I, *Trichoderma reesei* xylanase II, *Trichoderma reesei* xylanase III, *Trichoderma reesei* beta-xylosidase, and *Trichoderma reesei* translation elongation factor.

Preferred terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *Journal of Bacteriology* 177: 3465-3471).

The control sequence may also be a leader, a nontranslated region of an mRNA that is important for translation by the host cell. The leader is operably linked to the 5'-terminus of the polynucleotide encoding the polypeptide. Any leader that is functional in the host cell may be used.

Preferred leaders for filamentous fungal host cells are obtained from the genes for *Aspergillus oryzae* TAKA amylase and *Aspergillus nidulans* triose phosphate isomerase.

Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3'-terminus of the polynucleotide and, when transcribed, is recognized by the host cell as a signal to add polyadenosine residues to transcribed mRNA. Any polyadenylation sequence that is functional in the host cell may be used.

Preferred polyadenylation sequences for filamentous fungal host cells are obtained from the genes for *Aspergillus nidulans* anthranilate synthase, *Aspergillus niger* glucoamylase, *Aspergillus niger* alpha-glucosidase *Aspergillus oryzae* TAKA amylase, and *Fusarium oxysporum* trypsin-like protease.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a polypeptide and directs the polypeptide into the cell's secretory pathway. The 5'-end of the coding sequence of the polynucleotide may inherently contain a signal peptide coding sequence naturally linked in translation reading frame with the segment of the coding sequence that encodes the polypeptide. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the polypeptide. However, any signal peptide coding sequence that directs the expressed polypeptide into the secretory pathway of a host cell may be used.

Effective signal peptide coding sequences for bacterial host cells are the signal peptide coding sequences obtained from the genes for *Bacillus* NCIB 11837 maltogenic amylase, *Bacillus licheniformis* subtilisin, *Bacillus licheniformis* beta-lactamase, *Bacillus stearothermophilus* alpha-amylase, *Bacillus stearothermophilus* neutral proteases (nprT, nprS, nprM), and *Bacillus subtilis* prsA. Further signal peptides are described by Simonen and Palva, 1993, *Microbiological Reviews* 57: 109-137.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

The control sequence may also be a propeptide coding sequence that encodes a propeptide positioned at the N-terminus of a polypeptide. The resultant polypeptide is known as a proenzyme or propolypeptide (or a zymogen in some cases). A propolypeptide is generally inactive and can be converted to an active polypeptide by catalytic or autocatalytic cleavage of the propeptide from the propolypeptide. The propeptide coding sequence may be obtained from the genes for *Bacillus subtilis* alkaline protease (aprE), *Bacillus subtilis* neutral protease (nprT), *Myceliophthora thermophila* laccase (WO 95/33836), *Rhizomucor miehei* aspartic proteinase, and *Saccharomyces cerevisiae* alpha-factor.

Where both signal peptide and propeptide sequences are present, the propeptide sequence is positioned next to the N-terminus of a polypeptide and the signal peptide sequence is positioned next to the N-terminus of the propeptide sequence.

It may also be desirable to add regulatory sequences that regulate expression of the polypeptide relative to the growth of the host cell. Examples of regulatory sequences are those that cause expression of the gene to be turned on or off in response to a chemical or physical stimulus, including the presence of a regulatory compound. Regulatory sequences in prokaryotic systems include the lac, tac, and trp operator systems. In yeast, the ADH2 system or GAL1 system may be used. In filamentous fungi, the *Aspergillus niger* glucoamylase promoter, *Aspergillus oryzae* TAKA alpha-amylase promoter, and *Aspergillus oryzae* glucoamylase promoter, *Trichoderma reesei* cellobiohydrolase I promoter, and *Trichoderma reesei* cellobiohydrolase II promoter may be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the polypeptide would be operably linked to the regulatory sequence.

Expression Vectors

The present invention also relates to recombinant expression vectors comprising a polynucleotide of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the polypeptide at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used.

The vector preferably contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Examples of bacterial selectable markers are *Bacillus licheniformis* or *Bacillus subtilis* dal genes, or markers that confer antibiotic resistance such as ampicillin, chloramphenicol, kanamycin, neomycin, spectinomycin, or tetracycline resistance. Suitable markers for yeast host cells include, but are not limited to, ADE2, HIS3, LEU2, LYS2, MET3, TRP1, and URA3. Selectable markers for use in a filamentous fungal host cell include, but are not limited to, adeA (phosphoribosylaminoimidazole-succinocarboxamide synthase), adeB (phosphoribosylaminoimidazole synthase), amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene. Preferred for use in a *Trichoderma* cell are adeA, adeB, amdS, hph, and pyrG genes.

The selectable marker may be a dual selectable marker system as described in WO 2010/039889. In one aspect, the dual selectable marker is an hph-tk dual selectable marker system.

The vector preferably contains an element(s) that permits integration of the vector into the host cell's genome or autonomous replication of the vector in the cell independent of the genome.

For integration into the host cell genome, the vector may rely on the polynucleotide's sequence encoding the polypeptide or any other element of the vector for integration into the genome by homologous or non-homologous recombination. Alternatively, the vector may contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication that functions in a cell. The term "origin of replication" or "plasmid replicator" means a polynucleotide that enables a plasmid or vector to replicate in vivo.

Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention may be inserted into a host cell to increase production of a polypeptide. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising a polynucleotide of the present invention operably linked to one or more control sequences that direct the production of a polypeptide of the present invention. A construct or vector comprising a polynucleotide is introduced into a host cell so that the construct or vector is maintained as a chromosomal integrant or as a self-replicating extra-chromosomal vector as described earlier. The term "host cell" encompasses any progeny of a parent cell that is not identical to the parent cell due to mutations that occur during replication. The choice of a host cell will to a large extent depend upon the gene encoding the polypeptide and its source.

The host cell may be any cell useful in the recombinant production of a polypeptide of the present invention, e.g., a prokaryote or a eukaryote.

The prokaryotic host cell may be any Gram-positive or Gram-negative bacterium. Gram-positive bacteria include, but are not limited to, *Bacillus, Clostridium, Enterococcus, Geobacillus, Lactobacillus, Lactococcus, Oceanobacillus, Staphylococcus, Streptococcus*, and *Streptomyces*. Gram-negative bacteria include, but are not limited to, *Campylobacter, E. coli, Flavobacterium, Fusobacterium, Helicobacter, Ilyobacter, Neisseria, Pseudomonas, Salmonella*, and *Ureaplasma*.

The bacterial host cell may be any *Bacillus* cell including, but not limited to, *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis*, and *Bacillus thuringiensis* cells.

The bacterial host cell may also be any *Streptococcus* cell including, but not limited to, *Streptococcus equisimilis, Streptococcus pyogenes, Streptococcus uberis*, and *Streptococcus equi* subsp. *Zooepidemicus* cells.

The bacterial host cell may also be any *Streptomyces* cell including, but not limited to, *Streptomyces achromogenes, Streptomyces avermitilis, Streptomyces coelicolor, Streptomyces griseus*, and *Streptomyces lividans* cells.

The introduction of DNA into a *Bacillus* cell may be effected by protoplast transformation (see, e.g., Chang and Cohen, 1979, *Mol. Gen. Genet.* 168: 111-115), competent cell transformation (see, e.g., Young and Spizizen, 1961, *J. Bacteriol.* 81: 823-829, or Dubnau and Davidoff-Abelson, 1971, *J. Mol. Biol.* 56: 209-221), electroporation (see, e.g., Shigekawa and Dower, 1988, *Biotechniques* 6: 742-751), or conjugation (see, e.g., Koehler and Thorne, 1987, *J. Bacteriol.* 169: 5271-5278). The introduction of DNA into an *E. coli* cell may be effected by protoplast transformation (see, e.g., Hanahan, 1983, *J. Mol. Biol.* 166: 557-580) or electroporation (see, e.g., Dower et al., 1988, *Nucleic Acids Res.* 16: 6127-6145). The introduction of DNA into a *Streptomyces* cell may be effected by protoplast transformation, electroporation (see, e.g., Gong et al., 2004, *Folia Microbiol.* (Praha) 49: 399-405), conjugation (see, e.g., Mazodier et al., 1989, *J. Bacteriol.* 171: 3583-3585), or transduction (see, e.g., Burke et al., 2001, *Proc. Natl. Acad. Sci. USA* 98: 6289-6294). The introduction of DNA into a *Pseudomonas* cell may be effected by electroporation (see, e.g., Choi et al., 2006, *J. Microbiol. Methods* 64: 391-397) or conjugation (see, e.g., Pinedo and Smets, 2005, *Appl. Environ. Microbiol.* 71: 51-57). The introduction of DNA into a *Streptococcus* cell may be effected by natural competence (see, e.g., Perry and Kuramitsu, 1981, *Infect. Immun.* 32: 1295-1297), protoplast transformation (see, e.g., Catt and Jollick, 1991, *Microbios* 68: 189-207), electroporation (see, e.g., Buckley et al., 1999, *Appl. Environ. Microbiol.* 65: 3800-3804), or conjugation (see, e.g., Clewell, 1981, *Microbiol. Rev.* 45: 409-436). However, any method known in the art for introducing DNA into a host cell can be used.

The host cell may also be a eukaryote, such as a mammalian, insect, plant, or fungal cell.

The host cell may be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, *Ainsworth and Bisby's Dictionary of The Fungi*, 8th edition, 1995, CAB International, University Press, Cambridge, UK).

The fungal host cell may be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in *Biology and Activities of Yeast* (Skinner, Passmore, and Davenport, editors, Soc. App. Bacteriol. Symposium Series No. 9, 1980).

The yeast host cell may be a *Candida, Hansenula, Kluyveromyces, Pichia, Saccharomyces, Schizosaccharomyces*, or *Yarrowia* cell, such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis*, or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes*, or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor, Trichoderma harzianum, Trichoderma koningii, Trichoderma longibrachiatum, Trichoderma reesei*, or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al., 1984, *Proc. Natl. Acad. Sci. USA* 81: 1470-1474, and Christensen et al., 1988, *Bio/Technology* 6: 1419-1422. Suitable methods for transforming *Fusarium* species are described by Malardier et al., 1989, *Gene* 78: 147-156, and WO 96/00787. Yeast may be transformed using the procedures described by Becker and Guarente, In Abelson, J. N.

and Simon, M. I., editors, *Guide to Yeast Genetics and Molecular Biology, Methods in Enzymology*, Volume 194, pp 182-187, Academic Press, Inc., New York; Ito et al., 1983, *J. Bacteriol.* 153: 163; and Hinnen et al., 1978, *Proc. Natl. Acad. Sci. USA* 75: 1920.

Methods of Production

The present invention also relates to methods of producing a polypeptide of the present invention, comprising (a) cultivating a cell, which in its wild-type form produces the polypeptide, under conditions conducive for production of the polypeptide; and optionally, (b) recovering the polypeptide. In one aspect, the cell is a *Paenibacillus* cell. In another aspect, the cell is a *Paenibacillus illinoisensis* cell. In another aspect, the cell is a *Paenibacillus campinasensis* cell. In another aspect, the cell is a *Paenibacillus favisporus* cell. In another aspect, the cell is a *Paenibacillus* tundra cell. In another aspect, the cell is a *Paenibacillus xylanexedens* cell. In another aspect, the cell is a *Paenibacillus chitinolyticus* cell. In another aspect, the cell is a *Paenibacillus* sp-18054 cell. In another aspect, the cell is a *Paenibacillus* sp-62250 cell. In another aspect, the cell is a *Paenibacillus* sp-62603 cell. In another aspect, the cell is a *Paenibacillus* sp-19179 cell. In another aspect, the cell is a *Paenibacillus* sp-62332 cell. In another aspect, the cell is a *Paenibacillus* sp-62248 cell.

In a further aspect, the cell is a *Chryseobacterium* cell. In another aspect, the cell is a *Chryseobacterium* sp-10696 cell.

The present invention also relates to methods of producing a polypeptide of the present invention, comprising (a) cultivating a recombinant host cell of the present invention under conditions conducive for production of the polypeptide; and optionally, (b) recovering the polypeptide.

The host cells are cultivated in a nutrient medium suitable for production of the polypeptide using methods known in the art. For example, the cells may be cultivated by shake flask cultivation, or small-scale or large-scale fermentation (including continuous, batch, fed-batch, or solid state fermentations) in laboratory or industrial fermentors in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the polypeptide is secreted into the nutrient medium, the polypeptide can be recovered directly from the medium. If the polypeptide is not secreted, it can be recovered from cell lysates.

The polypeptide may be detected using methods known in the art that are specific for the polypeptides. These detection methods include, but are not limited to, use of specific antibodies, formation of an enzyme product, or disappearance of an enzyme substrate. For example, an enzyme assay may be used to determine the activity of the polypeptide.

The polypeptide may be recovered using methods known in the art. For example, the polypeptide may be recovered from the nutrient medium by conventional procedures including, but not limited to, collection, centrifugation, filtration, extraction, spray-drying, evaporation, or precipitation. In one aspect, a fermentation broth comprising the polypeptide is recovered.

The polypeptide may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, Janson and Ryden, editors, VCH Publishers, New York, 1989) to obtain substantially pure polypeptides.

In an alternative aspect, the polypeptide is not recovered, but rather a host cell of the present invention expressing the polypeptide is used as a source of the polypeptide.

Plants

The present invention also relates to isolated plants, e.g., a transgenic plant, plant part, or plant cell, comprising a polynucleotide of the present invention so as to express and produce a polypeptide or domain in recoverable quantities. The polypeptide or domain may be recovered from the plant or plant part. Alternatively, the plant or plant part containing the polypeptide or domain may be used as such for improving the quality of a food or feed, e.g., improving nutritional value, palatability, and rheological properties, or to destroy an antinutritive factor.

The transgenic plant can be dicotyledonous (a dicot) or monocotyledonous (a monocot). Examples of monocot plants are grasses, such as meadow grass (blue grass, *Poa*), forage grass such as *Festuca, Lolium*, temperate grass, such as *Agrostis*, and cereals, e.g., wheat, oats, rye, barley, rice, *sorghum*, and maize (corn).

Examples of dicot plants are tobacco, legumes, such as lupins, potato, sugar beet, pea, bean and soybean, and cruciferous plants (family Brassicaceae), such as cauliflower, rape seed, and the closely related model organism *Arabidopsis thaliana*.

Examples of plant parts are stem, callus, leaves, root, fruits, seeds, and tubers as well as the individual tissues comprising these parts, e.g., epidermis, mesophyll, parenchyme, vascular tissues, meristems.

Plant cells and specific plant cell compartments, such as chloroplasts, apoplasts, mitochondria, vacuoles, peroxisomes and cytoplasm are also considered to be a plant part.

Also included within the scope of the present invention are the progeny of such plants, plant parts, and plant cells.

The transgenic plant or plant cell expressing the polypeptide or domain may be constructed in accordance with methods known in the art.

The present invention also relates to methods of producing a polypeptide or domain of the present invention comprising (a) cultivating a transgenic plant or a plant cell comprising a polynucleotide encoding the polypeptide or domain under conditions conducive for production of the polypeptide or domain; and (b) recovering the polypeptide or domain.

Fermentation Broth Formulations or Cell Compositions

The present invention also relates to a fermentation broth formulation or a cell composition comprising a polypeptide of the present invention. The fermentation broth product further comprises additional ingredients used in the fermentation process, such as, for example, cells (including, the host cells containing the gene encoding the polypeptide of the present invention which are used to produce the polypeptide of interest), cell debris, biomass, fermentation media and/or fermentation products. In some embodiments, the composition is a cell-killed whole broth containing organic acid(s), killed cells and/or cell debris, and culture medium.

The term "fermentation broth" as used herein refers to a preparation produced by cellular fermentation that undergoes no or minimal recovery and/or purification. For example, fermentation broths are produced when microbial cultures are grown to saturation, incubated under carbon-limiting conditions to allow protein synthesis (e.g., expression of enzymes by host cells) and secretion into cell culture medium. The fermentation broth can contain unfractionated or fractionated contents of the fermentation materials derived at the end of the fermentation. Typically, the fermentation broth is unfractionated and comprises the spent culture medium and cell debris present after the microbial cells (e.g., filamentous fungal cells) are removed, e.g., by centrifugation. In some embodiments, the fermentation broth contains spent cell culture medium, extracellular enzymes, and viable and/or nonviable microbial cells.

In an embodiment, the fermentation broth formulation and cell compositions comprise a first organic acid component comprising at least one 1-5 carbon organic acid and/or a salt thereof and a second organic acid component comprising at least one 6 or more carbon organic acid and/or a salt thereof. In a specific embodiment, the first organic acid component is acetic acid, formic acid, propionic acid, a salt thereof, or a mixture of two or more of the foregoing and the second organic acid component is benzoic acid, cyclohexanecarboxylic acid, 4-methylvaleric acid, phenylacetic acid, a salt thereof, or a mixture of two or more of the foregoing.

In one aspect, the composition contains an organic acid(s), and optionally further contains killed cells and/or cell debris. In one embodiment, the killed cells and/or cell debris are removed from a cell-killed whole broth to provide a composition that is free of these components.

The fermentation broth formulations or cell compositions may further comprise a preservative and/or anti-microbial (e.g., bacteriostatic) agent, including, but not limited to, sorbitol, sodium chloride, potassium sorbate, and others known in the art.

The cell-killed whole broth or composition may contain the unfractionated contents of the fermentation materials derived at the end of the fermentation. Typically, the cell-killed whole broth or composition contains the spent culture medium and cell debris present after the microbial cells (e.g., filamentous fungal cells) are grown to saturation, incubated under carbon-limiting conditions to allow protein synthesis. In some embodiments, the cell-killed whole broth or composition contains the spent cell culture medium, extracellular enzymes, and killed filamentous fungal cells. In some embodiments, the microbial cells present in the cell-killed whole broth or composition can be permeabilized and/or lysed using methods known in the art.

A whole broth or cell composition as described herein is typically a liquid, but may contain insoluble components, such as killed cells, cell debris, culture media components, and/or insoluble enzyme(s). In some embodiments, insoluble components may be removed to provide a clarified liquid composition.

The whole broth formulations and cell compositions of the present invention may be produced by a method described in WO 90/15861 or WO 2010/096673.

Enzyme Compositions

The present invention also relates to compositions comprising a polypeptide of the present invention. Preferably, the compositions are enriched in the polypeptide of the invention. The term "enriched" indicates that the xylanase activity of the composition has been increased, e.g., with an enrichment factor of at least 1.1, such as at least 1.2, at least 1.3, at least 1.4, at least 1.5, at least 2.0, at least 3.0, at least 4.0, at least 5.0, at least 10.

In an embodiment, the composition comprises the polypeptide of the invention and one or more formulating agents, as described below.

In one aspect, the invention relates to a composition comprising a formulating agent and a GH5 polypeptide of the invention, wherein the GH5 polypeptide of the invention releases at least 3% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine of the invention. In an embodiment, the percentage solubilised xylose is at least 3.5%, such as at least 4%, at least 4.5%, at least 5% or at least 5.5%.

In a preferred embodiment, the composition comprises a formulating agent and a GH5 polypeptide, wherein the GH5 polypeptide releases at least 6% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-two, twenty-four, twenty-five, twenty-seven, twenty-eight, thirty, thirty-one, thirty-two, thirty-three, thirty-four, thirty-five, thirty-six, thirty-eight and/or thirty-nine of the invention. In an embodiment, the percentage solubilised xylose is at least 6.5%, such as at least 7% or at least 7.5%.

In a more preferred embodiment, the composition comprises a formulating agent and a GH5 polypeptide, wherein the GH5 polypeptide releases at least 8% solubilized xylose from plant based material from the sub-family Panicoideae when the method is performed under the reaction conditions 10 mg GH5 polypeptide per kg DFDSM and incubation at 40° C., pH 5 for 4 hours. In an embodiment, the GH5 polypeptide is the polypeptide of one or more, such as all, of aspects twenty-five, twenty-seven, twenty-eight, thirty, thirty-three, thirty-four, thirty-five, thirty-six and/or thirty-nine of the invention.

The compositions may further comprise multiple enzymatic activities, such as one or more (e.g., several) enzymes selected from the group consisting of phytase, xylanase, galactanase, alpha-galactosidase, protease, phospholipase A1, phospholipase A2, lysophospholipase, phospholipase C, phospholipase D, amylase, lysozyme, arabinofuranosidase, beta-xylosidase, acetyl xylan esterase, feruloyl esterase, cellulase, cellobiohydrolases, beta-glucosidase, pullulanase, and beta-glucanase or any combination thereof.

The compositions may further comprise one or more microbes. In an embodiment, the microbe is selected from the group consisting of *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Bifidobacterium bifidum, Bifidobacterium animalis, Bifidobacterium sp., Carnobacterium sp., Clostridium butyricum, Clostridium sp., Enterococcus faecium, Enterococcus sp., Lactobacillus sp., Lactobacillus acidophilus, Lactobacillus farciminus, Lactobacillus rhamnosus, Lactobacillus reuteri, Lactobacillus salivarius, Lactococcus lactis, Lactococcus sp., Leuconostoc sp., Megasphaera elsdenii, Megasphaera sp., Pediococsus acidilactici, Pediococcus sp., Propionibacterium thoenii, Propionibacterium sp. and Streptococcus sp.* or any combination thereof.

Formulating Agent

The enzyme of the invention may be formulated as a liquid or a solid. For a liquid formulation, the formulating agent may comprise a polyol (such as e.g. glycerol, ethylene glycol or propylene glycol), a salt (such as e.g. sodium chloride, sodium benzoate, potassium sorbate) or a sugar or sugar derivative (such as e.g. dextrin, glucose, sucrose, and sorbitol). Thus in one embodiment, the composition is a liquid composition comprising the polypeptide of the invention and one or more formulating agents selected from the list consisting of glycerol, ethylene glycol, 1,2-propylene glycol, 1,3-propylene glycol, sodium chloride, sodium benzoate, potassium sorbate, dextrin, glucose, sucrose, and sorbitol. The liquid formulation may be sprayed onto the feed after it has been pelleted or may be added to drinking water given to the animals.

For a solid formulation, the formulation may be for example as a granule, spray dried powder or agglomerate. The formulating agent may comprise a salt (organic or inorganic zinc, sodium, potassium or calcium salts such as e.g. such as calcium acetate, calcium benzoate, calcium carbonate, calcium chloride, calcium citrate, calcium sorbate, calcium sulfate, potassium acetate, potassium benzoate, potassium carbonate, potassium chloride, potassium citrate, potassium sorbate, potassium sulfate, sodium acetate, sodium benzoate, sodium carbonate, sodium chloride, sodium citrate, sodium sulfate, zinc acetate, zinc benzoate, zinc carbonate, zinc chloride, zinc citrate, zinc sorbate, zinc sulfate), starch or a sugar or sugar derivative (such as e.g. sucrose, dextrin, glucose, lactose, sorbitol).

In an embodiment, the solid composition is in granulated form. The granule may have a matrix structure where the components are mixed homogeneously. However, the granule typically comprises a core particle and one or more coatings, which typically are salt and/or wax coatings. The core particle can either be a homogeneous blend of xylanase of the invention optionally combined with one or more additional enzymes and optionally together with one or more salts or an inert particle with the xylanase of the invention optionally combined with one or more additional enzymes applied onto it.

In an embodiment, the material of the core particles are selected from the group consisting of inorganic salts (such as calcium acetate, calcium benzoate, calcium carbonate, calcium chloride, calcium citrate, calcium sorbate, calcium sulfate, potassium acetate, potassium benzoate, potassium carbonate, potassium chloride, potassium citrate, potassium sorbate, potassium sulfate, sodium acetate, sodium benzoate, sodium carbonate, sodium chloride, sodium citrate, sodium sulfate, zinc acetate, zinc benzoate, zinc carbonate, zinc chloride, zinc citrate, zinc sorbate, zinc sulfate), starch or a sugar or sugar derivative (such as e.g. sucrose, dextrin, glucose, lactose, sorbitol), sugar or sugar derivative (such as e.g. sucrose, dextrin, glucose, lactose, sorbitol), small organic molecules, starch, flour, cellulose and minerals.

The salt coating is typically at least 1 µm thick and can either be one particular salt or a mixture of salts, such as $Na_2SO_4$, $K_2SO_4$, $MgSO_4$ and/or sodium citrate. Other examples are those described in e.g. WO 2008/017659, WO 2006/034710, WO 1997/05245, WO 1998/54980, WO 1998/55599, WO 2000/70034 or polymer coating such as described in WO 2001/00042.

In another embodiment, the composition is a solid composition comprising the xylanase of the invention and one or more formulating agents selected from the list consisting of sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In a preferred embodiment, the formulating agent is selected from one or more of the following compounds: sodium sulfate, dextrin, cellulose, sodium thiosulfate and calcium carbonate. In a preferred embodiment, the solid composition is in granulated form. In an embodiment, the solid composition is in granulated form and comprises a core particle, an enzyme layer comprising the xylanase of the invention and a salt coating.

In a further embodiment, the formulating agent is selected from one or more of the following compounds: glycerol, ethylene glycol, 1, 2-propylene glycol or 1, 3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose. In a preferred embodiment, the formulating agent is selected from one or more of the following compounds: 1, 2-propylene glycol, 1, 3-propylene glycol, sodium sulfate, dextrin, cellulose, sodium thiosulfate and calcium carbonate.

Plant Based Material from the Sub-Family Panicoideae

In one embodiment, the plant based material from the sub-family Panicoideae is from the tribe Andropogoneae such as the rank *Andropogon* or *Andropterum* or *Apluda* or *Apocopis* or *Arthraxon* or *Bothriochloa* or *Capillipedium* or *Chionachne* or *Chrysopogon* or *Coelorachis* or *Coix* or *Cymbopogon* or *Dichanthium* or *Diheteropogon* or *Dimeria* or *Elionurus* or *Eremochloa* or *Euclasta* or *Eulalia* or *Germainia* or *Hemarthria* or *Heteropholis* or *Heteropogon* or *Hyparrhenia* or *Hyperthelia* or *Imperata* or *Ischaemum* or *Iseilema* or *Kerriochloa* or *Microstegium* or *Miscanthidium* or *Miscanthus* or *Mnesithea* or *Ophiuros* or *Oxyrhachis* or *Phacelurus* or *Pholiurus* or *Pogonatherum* or *Polytoca* or *Polytrias* or *Pseudopogonatherum* or *Pseudosorghum* or *Rhytachne* or *Rottboellia* or *Saccharum* or *Sarga* or *Schizachyrium* or *Sehima* or *Sorghastrum* or *Sorghum* or *Spodiopogon* or *Thaumastochloa* or *Thelepogon* or *Themeda* or *Trachypogon* or *Triarrhena* or *Tripsacum* or *Urelytrum* or *Vetiveria* or *Vossia* or *Xerochloa* or *Zea*.

In a preferred embodiment, the plant based material from the sub-family Panicoideae is from the rank *Zea*, such as the species *Zea diploperennis*, *Zea luxurians*, *Zea mays*, *Zea nicaraguensis* or *Zea perennis*.

In a preferred embodiment, the plant based material from the sub-family Panicoideae is from the rank *Sorghum*, such as the species *Sorghum amplum*, *Sorghum angustum*, *Sorghum arundinaceum*, *Sorghum australiense*, *Sorghum bicolor*, *Sorghum brachypodum*, *Sorghum bulbosum*, *Sorghum ecarinatum*, *Sorghum exstans*, *Sorghum grande*, *Sorghum halepense*, *Sorghum hybrid cultivar*, *Sorghum interjectum*, *Sorghum intrans*, *Sorghum laxiflorum*, *Sorghum leiocladum*, *Sorghum macrospermum*, *Sorghum matarankense*, *Sorghum nitidum*, *Sorghum plumosum*, *Sorghum propinquum*, *Sorghum purpureosericeum*, *Sorghum stipoideum*, *Sorghum sudanense*, *Sorghum timorense*, *Sorghum versicolor*, *Sorghum* sp. 'Silk' or *Sorghum* sp. as defined in WO2007/002267.

In another embodiment, the plant based material from the sub-family Panicoideae is from the tribe Paniceae such as the rank *Acritochaete*, *Acroceras*, *Alexfloydia*, *Alloteropsis*, *Amphicarpum*, *Ancistrachne*, *Anthephora*, *Brachiaria*, *Calyptochloa*, *Cenchrus*, *Chaetium*, *Chaetopoa*, *Chamaeraphis*, *Chlorocalymma*, *Cleistochloa*, *Cyphochlaena*, *Cyrtococcum*, *Dichanthelium*, *Digitaria*, *Dissochondrus*, *Echinochloa*, *Entolasia*, *Eriochloa*, *Homopholis*, *Hygrochloa*, *Hylebates*, *Ixophorus*, *Lasiacis*, *Leucophrys*, *Louisiella*, *Megaloprotachne*, *Megathyrsus*, *Melinis*, *Microcalamus*, *Moorochloa*, *Neurachne*, *Odontelytrum*, *Oplismenus*, *Ottochloa*, *Panicum*, *Paractaenum*, *Paraneurachne*, *Paratheria*, *Parodiophyllochloa*, *Paspalidium*, *Pennisetum*, *Plagiosetum*, *Poecilostachys*, *Pseudechinolaena*,

*Pseudochaetochloa, Pseudoraphis, Rupichloa, Sacciolepis, Scutachne, Setaria, Setariopsis, Snowdenia, Spinifex, Stenotaphrum, Stereochlaena, Thrasya, Thuarea, Thyridolepis, Tricholaena,* unclassified *Paniceae, Uranthoecium, Urochloa, Walwhalleya, Whiteochloa, Yakirra, Yvesia, Zuloagaea* or *Zygochloa*.

In a preferred embodiment, the plant based material from the sub-family Panicoideae is from the rank *Panicum*, such as the species *Panicum adenophorum, Panicum* aff. *aquaticum* JKT-2012, *Panicum amarum, Panicum antidotale, Panicum aquaticum, Panicum arctum, Panicum arundinariae, Panicum atrosanguineum, Panicum auricomum, Panicum auritum, Panicum bartlettii, Panicum bergii, Panicum bisulcatum, Panicum boliviense, Panicum brazzavillense, Panicum brevifolium, Panicum caaguazuense, Panicum campestre, Panicum capillare, Panicum cayennense, Panicum cayoense, Panicum cervicatum, Panicum chloroleucum, Panicum claytonii, Panicum coloratum, Panicum cyanescens, Panicum decompositum, Panicum deustum, Panicum dichotomiflorum, Panicum dinklagei, Panicum distichophyllum, Panicum dregeanum, Panicum elephantipes, Panicum fauriei, Panicum flexile, Panicum fluviicola, Panicum gouinii, Panicum gracilicaule, Panicum granuliferum, Panicum guatemalense, Panicum hallii, Panicum heterostachyum, Panicum hirticaule, Panicum hirtum, Panicum hylaeicum, Panicum incumbens, Panicum infestum, Panicum italicum, Panicum laetum, Panicum laevinode, Panicum lanipes, Panicum larcomianum, Panicum longipedicellatum, Panicum machrisianum, Panicum malacotrichum, Panicum margaritiferum, Panicum micranthum, Panicum miliaceum, Panicum milioides, Panicum millegrana, Panicum mystasipum, Panicum natalense, Panicum nephelophilum, Panicum nervosum, Panicum notatum, Panicum olyroides, Panicum paludosum, Panicum pansum, Panicum pantrichum, Panicum parvifolium, Panicum parviglume, Panicum pedersenii, Panicum penicillatum, Panicum petersonii, Panicum phragmitoides, Panicum piauiense, Panicum pilosum, Panicum pleianthum, Panicum polycomum, Panicum polygonatum, Panicum pseudisachne, Panicum pygmaeum, Panicum pyrularium, Panicum queenslandicum, Panicum racemosum, Panicum repens, Panicum rhizogonum, Panicum rigidulum, Panicum rivale, Panicum rude, Panicum rudgei, Panicum schinzii, Panicum schwackeanum, Panicum sellowii, Panicum seminudum, Panicum stapfianum, Panicum stenodes, Panicum stramineum, Panicum subalbidum, Panicum subtiramulosum, Panicum sumatrense, Panicum tenellum, Panicum tenuifolium, Panicum trichanthum, Panicum trichidiachne, Panicum trichoides, Panicum tricholaenoides, Panicum tuerckheimii, Panicum turgidum, Panicum urvilleanum, Panicum validum, Panicum venezuelae, Panicum verrucosum, Panicum virgatum, Panicum wettsteinii, Panicum* sp., *Panicum* sp. Christin 16-200, *Panicum* sp. ELS-2011, *Panicum* sp. EM389 or *Panicum* sp. Forest 761.

In a further embodiment, the plant based material from the sub-family Panicoideae is maize (*Zea*), corn (*Zea*), sorghum (*Sorghum*), switchgrass (*Panicum virgatum*), millet (*Panicum miliaceum*), pearl millet (*Cenchrus violaceus* also called *Pennisetum glaucum*), foxtail millet (*Setaria italica* also called *Panicum italicum*) or in a processed form such as milled corn, milled maize, defatted maize, defatted destarched maize, milled *sorghum*, milled switchgrass, milled millet, milled foxtail millet, milled pearl millet, or any combination thereof.

In an embodiment, the plant based material from the sub-family Panicoideae is from the seed of the plant. In a preferred embodiment, the plant based material from the sub-family Panicoideae is from the seed of maize (*Zea*), corn (*Zea*), sorghum (*Sorghum*), switchgrass (*Panicum virgatum*), millet (*Panicum miliaceum*), pearl millet (*Cenchrus violaceus* also called *Pennisetum glaucum*), foxtail millet (*Setaria italica* also called *Panicum italicum*) or wherein the seed has been processed such as milled corn, milled maize, defatted maize, defatted destarched maize, milled *sorghum*, milled switchgrass, milled millet, milled foxtail millet, milled pearl millet, or any combination thereof.

Animal Feed and Animal Feed Additives

The present invention also relates to animal feed compositions and animal feed additives comprising one or more xylanases of the invention. In an embodiment, the animal feed or animal feed additive comprises a formulating agent and one or more xylanases of the invention. In a further embodiment, the formulating agent comprises one or more of the following compounds: glycerol, ethylene glycol, 1, 2-propylene glycol or 1, 3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose.

Animal feed compositions or diets have a relatively high content of protein. Poultry and pig diets can be characterised as indicated in Table B of WO 01/58275, columns 2-3. Fish diets can be characterised as indicated in column 4 of this Table B. Furthermore such fish diets usually have a crude fat content of 200-310 g/kg.

An animal feed composition according to the invention has a crude protein content of 50-800 g/kg, and furthermore comprises at least one xylanase as claimed herein.

Furthermore, or in the alternative (to the crude protein content indicated above), the animal feed composition of the invention has a content of metabolisable energy of 10-30 MJ/kg; and/or a content of calcium of 0.1-200 g/kg; and/or a content of available phosphorus of 0.1-200 g/kg; and/or a content of methionine of 0.1-100 g/kg; and/or a content of methionine plus cysteine of 0.1-150 g/kg; and/or a content of lysine of 0.5-50 g/kg.

In particular embodiments, the content of metabolisable energy, crude protein, calcium, phosphorus, methionine, methionine plus cysteine, and/or lysine is within any one of ranges 2, 3, 4 or 5 in Table B of WO 01/58275 (R. 2-5).

Crude protein is calculated as nitrogen (N) multiplied by a factor 6.25, i.e. Crude protein (g/kg)=N (g/kg)×6.25. The nitrogen content is determined by the Kjeldahl method (A.O.A.C., 1984, Official Methods of Analysis 14th ed., Association of Official Analytical Chemists, Washington D.C.).

Metabolisable energy can be calculated on the basis of the NRC publication Nutrient requirements in swine, ninth revised edition 1988, subcommittee on swine nutrition, committee on animal nutrition, board of agriculture, national research council. National Academy Press, Washington, D.C., pp. 2-6, and the European Table of Energy Values for Poultry Feed-stuffs, Spelderholt centre for poultry research and extension, 7361 DA Beekbergen, The Netherlands. Grafisch bedrijf Ponsen & looijen by, Wageningen. ISBN 90-71463-12-5.

The dietary content of calcium, available phosphorus and amino acids in complete animal diets is calculated on the basis of feed tables such as Veevoedertabel 1997, gegevens over chemische samenstelling, verteerbaarheid en voederwaarde van voedermiddelen, Central Veevoederbureau, Runderweg 6, 8219 pk Lelystad. ISBN 90-72839-13-7.

In a particular embodiment, the animal feed composition of the invention contains at least one vegetable protein as defined above.

The animal feed composition of the invention may also contain animal protein, such as Meat and Bone Meal, Feather meal, and/or Fish Meal, typically in an amount of 0-25%. The animal feed composition of the invention may also comprise Dried Distillers Grains with Solubles (DDGS), typically in amounts of 0-30%.

In still further particular embodiments, the animal feed composition of the invention contains 0-80% maize; and/or 0-80% sorghum; and/or 0-70% wheat; and/or 0-70% Barley; and/or 0-30% oats; and/or 0-40% soybean meal; and/or 0-25% fish meal; and/or 0-25% meat and bone meal; and/or 0-20% whey.

The animal feed may comprise vegetable proteins. In particular embodiments, the protein content of the vegetable proteins is at least 10, 20, 30, 40, 50, 60, 70, 80, or 90% (w/w). Vegetable proteins may be derived from vegetable protein sources, such as legumes and cereals, for example, materials from plants of the families Fabaceae (Leguminosae), Cruciferaceae, Chenopodiaceae, and Poaceae, such as soy bean meal, lupin meal, rapeseed meal, and combinations thereof.

In a particular embodiment, the vegetable protein source is material from one or more plants of the family Fabaceae, e.g., soybean, lupine, pea, or bean. In another particular embodiment, the vegetable protein source is material from one or more plants of the family Chenopodiaceae, e.g. beet, sugar beet, spinach or *quinoa*. Other examples of vegetable protein sources are rapeseed, and cabbage. In another particular embodiment, soybean is a preferred vegetable protein source. Other examples of vegetable protein sources are cereals such as barley, wheat, rye, oat, maize (corn), rice, and *sorghum*.

Animal diets can e.g. be manufactured as mash feed (non-pelleted) or pelleted feed. Typically, the milled feedstuffs are mixed and sufficient amounts of essential vitamins and minerals are added according to the specifications for the species in question. Enzymes can be added as solid or liquid enzyme formulations. For example, for mash feed a solid or liquid enzyme formulation may be added before or during the ingredient mixing step. For pelleted feed the (liquid or solid) xylanase/enzyme preparation may also be added before or during the feed ingredient step. Typically a liquid xylanase/enzyme preparation comprises the xylanase of the invention optionally with a polyol, such as glycerol, ethylene glycol or propylene glycol, and is added after the pelleting step, such as by spraying the liquid formulation onto the pellets. The enzyme may also be incorporated in a feed additive or premix.

Alternatively, the xylanase can be prepared by freezing a mixture of liquid enzyme solution with a bulking agent such as ground soybean meal, and then lyophilizing the mixture.

In an embodiment, the animal feed comprises one or more additional enzymes. In an embodiment, the animal feed comprises one or more microbes. In an embodiment, the animal feed comprises one or more vitamins. In an embodiment, the animal feed comprises one or more minerals. In an embodiment, the animal feed comprises one or more amino acids. In an embodiment, the animal feed comprises one or more other feed ingredients.

In another embodiment, the animal feed comprises the polypeptide of the invention, one or more formulating agents and one or more additional enzymes. In an embodiment, the animal feed comprises the polypeptide of the invention, one or more formulating agents and one or more microbes. In an embodiment, the animal feed comprises the polypeptide of the invention, one or more formulating agents and one or more vitamins. In an embodiment, the animal feed comprises one or more minerals. In an embodiment, the animal feed comprises the polypeptide of the invention, one or more formulating agents and one or more amino acids. In an embodiment, the animal feed comprises the polypeptide of the invention, one or more formulating agents and one or more other feed ingredients.

In a further embodiment, the animal feed comprises the polypeptide of the invention, one or more formulating agents and one or more components selected from the list consisting of: one or more additional enzymes; one or more microbes; one or more vitamins; one or more minerals; one or more amino acids; and one or more other feed ingredients.

The final enzyme concentration in the diet is within the range of 0.01-200 mg enzyme protein per kg diet, preferably between 0.05-100 mg/kg diet, more preferably 0.1-50 mg, even more preferably 0.2-20 mg enzyme protein per kg animal diet.

It is at present contemplated that the enzyme is administered in one or more of the following amounts (dosage ranges): 0.01-200; 0.05-100; 0.1-50; 0.2-20; 0.1-1; 0.2-2; 0.5-5; or 1-10;—all these ranges being in mg xylanase protein per kg feed (ppm).

For determining mg xylanase protein per kg feed, the xylanase is purified from the feed composition, and the specific activity of the purified xylanase is determined using a relevant assay (see under xylanase activity). The xylanase activity of the feed composition as such is also determined using the same assay, and on the basis of these two determinations, the dosage in mg xylanase protein per kg feed is calculated.

In a particular embodiment, the animal feed additive of the invention is intended for being included (or prescribed as having to be included) in animal diets or feed at levels of 0.01 to 10.0%; more particularly 0.05 to 5.0%; or 0.2 to 1.0% (% meaning g additive per 100 g feed). This is so in particular for premixes.

The same principles apply for determining mg xylanase protein in feed additives. Of course, if a sample is available of the xylanase used for preparing the feed additive or the feed, the specific activity is determined from this sample (no need to purify the xylanase from the feed composition or the additive).

Additional Enzymes

In another embodiment, the compositions described herein optionally include one or more enzymes. Enzymes can be classified on the basis of the handbook Enzyme Nomenclature from NC-IUBMB, 1992), see also the ENZYME site at the internet: expasy.ch/enzyme/. ENZYME is a repository of information relative to the nomenclature of enzymes. It is primarily based on the recommendations of the Nomenclature Committee of the International Union of Biochemistry and Molecular Biology (IUB-MB), Academic Press, Inc., 1992, and it describes each type of characterized enzyme for which an EC (Enzyme Commission) number has been provided (Bairoch A. The ENZYME database, 2000, Nucleic Acids Res 28:304-305). This IUB-MB Enzyme nomenclature is based on their substrate specificity and occasionally on their molecular mechanism; such a classification does not reflect the structural features of these enzymes.

Another classification of certain glycoside hydrolase enzymes, such as endoglucanase, xylanase, galactanase, mannanase, dextranase, lysozyme and galactosidase is described in Henrissat et al, "The carbohydrate-active enzymes database (CAZy) in 2013", *Nucl. Acids Res.* (1 Jan. 2014) 42 (D1): D490-D495; see also www.cazy.org.

Thus the composition of the invention may also comprise at least one other enzyme selected from the group comprising of phytase (EC 3.1.3.8 or 3.1.3.26); xylanase (EC 3.2.1.8); galactanase (EC 3.2.1.89); alpha-galactosidase (EC 3.2.1.22); protease (EC 3.4); phospholipase A1 (EC 3.1.1.32); phospholipase A2 (EC 3.1.1.4); lysophospholipase (EC 3.1.1.5); phospholipase C (3.1.4.3); phospholipase D (EC 3.1.4.4); amylase such as, for example, alpha-amylase (EC 3.2.1.1); arabinofuranosidase (EC 3.2.1.55); beta-xylosidase (EC 3.2.1.37); acetyl xylan esterase (EC 3.1.1.72); feruloyl esterase (EC 3.1.1.73); cellulase (EC 3.2.1.4); cellobiohydrolases (EC 3.2.1.91); beta-glucosidase (EC 3.2.1.21); pullulanase (EC 3.2.1.41); alpha-mannosidase (EC 3.2.1.24), mannanase (EC 3.2.1.25) and beta-glucanase (EC 3.2.1.4 or EC 3.2.1.6), or any mixture thereof.

In a particular embodiment, the composition of the invention comprises a phytase (EC 3.1.3.8 or 3.1.3.26). Examples of commercially available phytases include Bio-Feed™ Phytase (Novozymes), Ronozyme® P, Ronozyme® NP and Ronozyme® HiPhos (DSM Nutritional Products), Natuphos™ (BASF), Finase® and Quantum® Blue (AB Enzymes), OptiPhos® (Huvepharma) Phyzyme® XP (Verenium/DuPont) and Axtra® PHY (DuPont). Other preferred phytases include those described in e.g. WO 98/28408, WO 00/43503, and WO 03/066847.

In a particular embodiment, the composition of the invention comprises a xylanase (EC 3.2.1.8). Examples of commercially available xylanases include Ronozyme® WX and Ronozyme® G2 (DSM Nutritional Products), Econase® XT and Barley (AB Vista), Xylathin® (Verenium), Hostazym® X (Huvepharma) and Axtra® XB (Xylanase/beta-glucanase, DuPont).

In a particular embodiment, the composition of the invention comprises a protease (EC 3.4). Examples of commercially available proteases include Ronozyme® ProAct (DSM Nutritional Products).

Microbes

In an embodiment, the animal feed composition further comprises one or more additional microbes. In a particular embodiment, the animal feed composition further comprises a bacterium from one or more of the following genera: *Lactobacillus, Lactococcus, Streptococcus, Bacillus, Pediococcus, Enterococcus, Leuconostoc, Carnobacterium, Propionibacterium, Bifidobacterium, Clostridium* and *Megasphaera* or any combination thereof.

In a preferred embodiment, animal feed composition further comprises a bacterium from one or more of the following strains: *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Enterococcus faecium, Enterococcus spp*, and *Pediococcus spp, Lactobacillus spp, Bifidobacterium spp, Lactobacillus acidophilus, Pediococcus acidilactici, Lactococcus lactis, Bifidobacterium bifidum, Propionibacterium thoenii, Lactobacillus farciminus, lactobacillus rhamnosus, Clostridium butyricum, Bifidobacterium animalis* ssp. *animalis, Lactobacillus reuteri, Lactobacillus salivarius* ssp. *salivarius, Megasphaera elsdenii, Propionibacteria sp.*

In a more preferred embodiment, animal feed composition further comprises a bacterium from one or more of the following strains of *Bacillus subtilis:* 3A-P4 (PTA-6506); 15A-P4 (PTA-6507); 22C-P1 (PTA-6508); 2084 (NRRL B-500130); LSSA01 (NRRL-B-50104); BS27 (NRRL B-501 05); BS 18 (NRRL B-50633); and BS 278 (NRRL B-50634).

The bacterial count of each of the bacterial strains in the animal feed composition is between $1 \times 10^4$ and $1 \times 10^{14}$ CFU/kg of dry matter, preferably between $1 \times 10^6$ and $1 \times 10^{12}$ CFU/kg of dry matter, and more preferably between $1 \times 10^7$ and $1 \times 10^{11}$ CFU/kg of dry matter. In a more preferred embodiment the bacterial count of each of the bacterial strains in the animal feed composition is between $1 \times 10^8$ and $1 \times 10^{16}$ CFU/kg of dry matter.

The bacterial count of each of the bacterial strains in the animal feed composition is between $1 \times 10^5$ and $1 \times 10^{15}$ CFU/animal/day, preferably between $1 \times 10^7$ and $1 \times 10^{13}$ CFU/animal/day, and more preferably between $1 \times 10^8$ and $1 \times 10^{12}$ CFU/animal/day. In a more preferred embodiment the bacterial count of each of the bacterial strains in the animal feed composition is between $1 \times 10^9$ and $1 \times 10^{11}$ CFU/animal/day.

In another embodiment, the one or more bacterial strains are present in the form of a stable spore.

Premix

In an embodiment, the animal feed may include a premix, comprising e.g. vitamins, minerals, enzymes, amino acids, preservatives, antibiotics, other feed ingredients or any combination thereof which are mixed into the animal feed.

Amino Acids

The composition of the invention may further comprise one or more amino acids. Examples of amino acids which are used in animal feed are lysine, alanine, beta-alanine, threonine, methionine and tryptophan.

Vitamins and Minerals

In another embodiment, the animal feed may include one or more vitamins, such as one or more fat-soluble vitamins and/or one or more water-soluble vitamins. In another embodiment, the animal feed may optionally include one or more minerals, such as one or more trace minerals and/or one or more macro minerals.

Usually fat- and water-soluble vitamins, as well as trace minerals form part of a so-called premix intended for addition to the feed, whereas macro minerals are usually separately added to the feed.

Non-limiting examples of fat-soluble vitamins include vitamin A, vitamin D3, vitamin E, and vitamin K, e.g., vitamin K3.

Non-limiting examples of water-soluble vitamins include vitamin B12, biotin and choline, vitamin B1, vitamin B2, vitamin B6, niacin, folic acid and panthothenate, e.g., Ca-D-panthothenate.

Non-limiting examples of trace minerals include boron, cobalt, chloride, chromium, copper, fluoride, iodine, iron, manganese, molybdenum, selenium and zinc.

Non-limiting examples of macro minerals include calcium, magnesium, potassium and sodium.

The nutritional requirements of these components (exemplified with poultry and piglets/pigs) are listed in Table A of WO 01/58275. Nutritional requirement means that these components should be provided in the diet in the concentrations indicated.

In the alternative, the animal feed additive of the invention comprises at least one of the individual components specified in Table A of WO 01/58275. At least one means either of, one or more of, one, or two, or three, or four and so forth up to all thirteen, or up to all fifteen individual components. More specifically, this at least one individual component is included in the additive of the invention in such an amount as to provide an in-feed-concentration within the range indicated in column four, or column five, or column six of Table A.

In a still further embodiment, the animal feed additive of the invention comprises at least one of the below vitamins, preferably to provide an in-feed-concentration within the ranges specified in the below Table 1 (for piglet diets, and broiler diets, respectively).

TABLE 1

Typical vitamin recommendations

| Vitamin | Piglet diet | Broiler diet |
| --- | --- | --- |
| Vitamin A | 10,000-15,000 IU/kg feed | 8-12,500 IU/kg feed |
| Vitamin D3 | 1800-2000 IU/kg feed | 3000-5000 IU/kg feed |
| Vitamin E | 60-100 mg/kg feed | 150-240 mg/kg feed |
| Vitamin K3 | 2-4 mg/kg feed | 2-4 mg/kg feed |
| Vitamin B1 | 2-4 mg/kg feed | 2-3 mg/kg feed |
| Vitamin B2 | 6-10 mg/kg feed | 7-9 mg/kg feed |
| Vitamin B6 | 4-8 mg/kg feed | 3-6 mg/kg feed |
| Vitamin B12 | 0.03-0.05 mg/kg feed | 0.015-0.04 mg/kg feed |
| Niacin (Vitamin B3) | 30-50 mg/kg feed | 50-80 mg/kg feed |
| Pantothenic acid | 20-40 mg/kg feed | 10-18 mg/kg feed |
| Folic acid | 1-2 mg/kg feed | 1-2 mg/kg feed |
| Biotin | 0.15-0.4 mg/kg feed | 0.15-0.3 mg/kg feed |
| Choline chloride | 200-400 mg/kg feed | 300-600 mg/kg feed |

Other Feed Ingredients

The composition of the invention may further comprise colouring agents, stabilisers, growth improving additives and aroma compounds/flavourings, polyunsaturated fatty acids (PUFAs); reactive oxygen generating species, antimicrobial peptides and anti-fungal polypeptides.

Examples of colouring agents are carotenoids such as beta-carotene, astaxanthin, and lutein.

Examples of aroma compounds/flavourings are creosol, anethol, deca-, undeca- and/or dodeca-lactones, ionones, irone, gingerol, piperidine, propylidene phatalide, butylidene phatalide, capsaicin and tannin.

Examples of antimicrobial peptides (AMP's) are CAP18, Leucocin A, Tritrpticin, Protegrin-1, Thanatin, Defensin, Lactoferrin, Lactoferricin, and Ovispirin such as Novispirin (Robert Lehrer, 2000), Plectasins, and Statins, including the compounds and polypeptides disclosed in WO 03/044049 and WO 03/048148, as well as variants or fragments of the above that retain antimicrobial activity.

Examples of antifungal polypeptides (AFP's) are the *Aspergillus giganteus*, and *Aspergillus niger* peptides, as well as variants and fragments thereof which retain antifungal activity, as disclosed in WO 94/01459 and WO 02/090384.

Examples of polyunsaturated fatty acids are 018, C20 and C22 polyunsaturated fatty acids, such as arachidonic acid, docosohexaenoic acid, eicosapentaenoic acid and gamma-linoleic acid.

Examples of reactive oxygen generating species are chemicals such as perborate, persulphate, or percarbonate; and enzymes such as an oxidase, an oxygenase or a syntethase.

The composition of the invention may further comprise at least one amino acid. Examples of amino acids which are used in animal feed are lysine, alanine, beta-alanine, threonine, methionine and tryptophan.

Uses

The present invention is also directed to methods for using the polypeptides having xylanase activity, or compositions thereof, for e.g. animal feed. The present invention is also directed to processes for using the polypeptides having xylanase activity, or compositions thereof, such as e.g. those described below.

Use in Animal Feed

The present invention is also directed to methods for using the xylanases of the invention in animal feed.

The term animal includes all animals. Examples of animals are non-ruminants, and ruminants. Ruminant animals include, for example, animals such as sheep, goats, and cattle, e.g. beef cattle, cows, and young calves. In a particular embodiment, the animal is a non-ruminant animal. Non-ruminant animals include mono-gastric animals, e.g. pigs or swine (including, but not limited to, piglets, growing pigs, and sows); poultry such as turkeys, ducks and chicken (including but not limited to broiler chicks, layers); horses (including but not limited to hotbloods, coldbloods and warm bloods), young calves; and fish (including but not limited to salmon, trout, tilapia, catfish and carps; and crustaceans (including but not limited to shrimps and prawns).

In the use according to the invention the xylanases can be fed to the animal before, after, or simultaneously with the diet. The latter is preferred.

In a particular embodiment, the xylanase, in the form in which it is added to the feed, or when being included in a feed additive, is well-defined. Well-defined means that the xylanase preparation is at least 50% pure as determined by Size-exclusion chromatography (see Example 12 of WO 01/58275). In other particular embodiments the xylanase preparation is at least 60, 70, 80, 85, 88, 90, 92, 94, or at least 95% pure as determined by this method.

A well-defined xylanase preparation is advantageous. For instance, it is much easier to dose correctly to the feed a xylanase that is essentially free from interfering or contaminating other xylanases. The term dose correctly refers in particular to the objective of obtaining consistent and constant results, and the capability of optimizing dosage based upon the desired effect.

For the use in animal feed, however, the xylanase need not be that pure; it may e.g. include other enzymes, in which case it could be termed a xylanase preparation.

The xylanase preparation can be (a) added directly to the feed, or (b) it can be used in the production of one or more intermediate compositions such as feed additives or premixes that is subsequently added to the feed (or used in a treatment process). The degree of purity described above refers to the purity of the original xylanase preparation, whether used according to (a) or (b) above.

Use in Improving Corn DDGS

The enzymes of the invention can also be used to improve the nutritional value of corn DDGS (distillers grains with solubles).

Fermentation products, such as ethanol, are typically produced by first grinding starch-containing material in a dry-grind or wet-milling process, then degrading the material into fermentable sugars using enzymes and finally converting the sugars directly or indirectly into the desired fermentation product using a fermenting organism. Liquid fermentation products are recovered from the fermented mash (often referred to as "beer mash"), e.g., by distillation, which separate the desired fermentation product from other liquids and/or solids. The remaining faction is referred to as "whole stillage". The whole stillage is dewatered and separated into a solid and a liquid phase, e.g., by centrifugation. The solid phase is referred to as "wet cake" (or "distillers wet grain" (DWG)) and the liquid phase (supernatant) is referred to as "thin stillage". Dewatered wet cake is dried to provide "Distillers Dried Grains" (DDG) used as nutrient in animal feed. Thin stillage is typically evaporated to provide condensate and syrup or may alternatively be recycled directly to the slurry tank as "backset". Condensate may either be forwarded to a methanator before being discharged or may be recycled to the slurry tank. The syrup may be blended into DDG or added to the wet cake before drying to produce DDGS (Distillers Dried Grain with Solubles).

Historically, over 85% of DDGS has been fed to dairy and beef cattle, and DDGS continues to be an excellent, economical feed ingredient for use in ruminant diets. A considerable amount of research has been conducted on the effects of feeding DDGS to poultry. Corn DDGS is an excellent feed ingredient for use in layer, broiler, duck and turkey diets and contains approximately 85% of the energy value in corn, has moderate levels of protein and essential amino acids, and is high in available phosphorus. DDGS is an acceptable ingredient for use in poultry diets and can be safely added at levels of 5% in starter diets for broilers and turkeys, and 12-15% in grower-finisher diets for broilers, turkeys, and laying hens. However, higher inclusion rates of standard DDGS especially in the starter period is not possible and leads to slower growth a reduced body weight. Thus the application also relates to a method for improving the nutritional value of plant material from the sub-family Panicoideae comprising treating plant material from the sub-family Panicoideae with the GH5 polypeptide of the invention.

In an embodiment, the GH5 polypeptide of the invention is one or more of aspects twenty-two, twenty-three, twenty-four, twenty-five, twenty-seven, twenty-eight, twenty-nine, thirty, thirty-one, thirty-two, thirty-three, thirty-four, thirty-five, thirty-six, thirty-seven, thirty-eight and/or thirty-nine. In a further embodiment, the GH5 polypeptide of the invention is one or more of SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 33, SEQ ID NO: 36, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76 SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 and/or SEQ ID NO: 130.

Preferred Embodiments of the Invention

Preferred embodiments of the invention are described in the set of items below.

1. A method of releasing xylose from plant based material, comprising treating plant based material from the sub-family Panicoideae with a composition comprising a formulating agent and a GH5 polypeptide having xylanase activity, wherein the GH5 polypeptide having xylanase activity:
   (A) comprises one or more of the following motifs:

```
                                    (SEQ ID NO: 19)
(a) motif I:    G[F/Y][A/S][V/G/A]HXY[P/V], (SEQ ID NO: 20)
(b) motif II:   [I/L/V][H/I/L/M/V][F/I/Y][D/E]
and             [I/L/V]XNEP, (SEQ ID NO: 21)
(c) motif III:  [D/G][A/T/W]XX[N/T]X[FILV]R[A/L/M]
                [A/F/H][I/L/M];
```

(B) comprises a polypeptide selected from the group consisting of:
   (a) a polypeptide having at least 80% sequence identity to the polypeptide of SEQ ID NO: 3 or the mature polypeptide of SEQ ID NO: 2;
   (b) a polypeptide having at least 80% sequence identity to the polypeptide of SEQ ID NO: 6 or the mature polypeptide of SEQ ID NO: 5;
   (c) a polypeptide having at least 80% sequence identity to the polypeptide of SEQ ID NO: 9 or the mature polypeptide of SEQ ID NO: 8;
   (d) a polypeptide having at least 80% sequence identity to the polypeptide of SEQ ID NO: 12 or the mature polypeptide of SEQ ID NO: 11;
   (e) a polypeptide having at least 80% sequence identity to the polypeptide of SEQ ID NO: 15 or the mature polypeptide of SEQ ID NO: 14;
   (f) a polypeptide having at least 80% sequence identity to the polypeptide of SEQ ID NO: 18 or the mature polypeptide of SEQ ID NO: 17;
   (g) a polypeptide having at least 80% sequence identity to the polypeptide of SEQ ID NO: 27 or the mature polypeptide of SEQ ID NO: 26;
   (h) a polypeptide having at least 80% sequence identity to the polypeptide of SEQ ID NO: 30 or the mature polypeptide of SEQ ID NO: 29;
   (i) a polypeptide having at least 80% sequence identity to the polypeptide of SEQ ID NO: 39 or the mature polypeptide of SEQ ID NO: 38;
   (j) a polypeptide having at least 80% sequence identity to the polypeptide of SEQ ID NO: 42 or the mature polypeptide of SEQ ID NO: 41;
   (k) a polypeptide having at least 80% sequence identity to the polypeptide of SEQ ID NO: 45 or the mature polypeptide of SEQ ID NO: 44;
   (l) a polypeptide having at least 80% sequence identity to the polypeptide of SEQ ID NO: 48 or the mature polypeptide of SEQ ID NO: 47;
   (m) a polypeptide having at least 80% sequence identity to the polypeptide of SEQ ID NO: 67 or the mature polypeptide of SEQ ID NO: 66;
   (n) a polypeptide having at least 80% sequence identity to the polypeptide of SEQ ID NO: 70 or the mature polypeptide of SEQ ID NO: 69;
   (o) a polypeptide having at least 80% sequence identity to the polypeptide of SEQ ID NO: 73 or the mature polypeptide of SEQ ID NO: 72;
   (p) a polypeptide having at least 80% sequence identity to the polypeptide of SEQ ID NO: 76 or the mature polypeptide of SEQ ID NO: 75;
   (q) a polypeptide having at least 80% sequence identity to the polypeptide of SEQ ID NO: 79 or the mature polypeptide of SEQ ID NO: 78;
   (r) a polypeptide having at least 80% sequence identity to the polypeptide of SEQ ID NO: 82 or the mature polypeptide of SEQ ID NO: 81;
   (s) a polypeptide having at least 80% sequence identity to the polypeptide of SEQ ID NO: 85 or the mature polypeptide of SEQ ID NO: 84;
   (t) a polypeptide having at least 80% sequence identity to the polypeptide of SEQ ID NO: 88 or the mature polypeptide of SEQ ID NO: 87;
   (u) a polypeptide having at least 80% sequence identity to the polypeptide of SEQ ID NO: 91 or the mature polypeptide of SEQ ID NO: 90;

(v) a polypeptide having at least 80% sequence identity to the polypeptide of SEQ ID NO: 94 or the mature polypeptide of SEQ ID NO: 93;
(w) a polypeptide having at least 80% sequence identity to the polypeptide of SEQ ID NO: 97 or the mature polypeptide of SEQ ID NO: 96;
(x) a polypeptide having at least 80% sequence identity to the polypeptide of SEQ ID NO: 100 or the mature polypeptide of SEQ ID NO: 99;
(y) a polypeptide having at least 80% sequence identity to the polypeptide of SEQ ID NO: 103 or the mature polypeptide of SEQ ID NO: 102;
(z) a polypeptide having at least 80% sequence identity to the polypeptide of SEQ ID NO: 106 or the mature polypeptide of SEQ ID NO: 105;
(aa) a polypeptide having at least 80% sequence identity to the polypeptide of SEQ ID NO: 109 or the mature polypeptide of SEQ ID NO: 108;
(ab) a polypeptide having at least 80% sequence identity to the polypeptide of SEQ ID NO: 112 or the mature polypeptide of SEQ ID NO: 111;
(ac) a polypeptide having at least 80% sequence identity to the polypeptide of SEQ ID NO: 115 or the mature polypeptide of SEQ ID NO: 114;
(ad) a polypeptide having at least 80% sequence identity to the polypeptide of SEQ ID NO: 118 or the mature polypeptide of SEQ ID NO: 117;
(ae) a polypeptide having at least 80% sequence identity to the polypeptide of SEQ ID NO: 121 or the mature polypeptide of SEQ ID NO: 120;
(af) a polypeptide having at least 80% sequence identity to the polypeptide of SEQ ID NO: 124 or the mature polypeptide of SEQ ID NO: 123;
(ag) a polypeptide having at least 80% sequence identity to the polypeptide of SEQ ID NO: 127 or the mature polypeptide of SEQ ID NO: 126;
(ah) a polypeptide having at least 80% sequence identity to the polypeptide of SEQ ID NO: 130 or the mature polypeptide of SEQ ID NO: 129;
(ai) a polypeptide encoded by a polynucleotide that hybridizes under high stringency conditions, or very high stringency conditions with
  (i) the mature polypeptide coding sequence of SEQ ID NO: 1,
  (ii) the mature polypeptide coding sequence of SEQ ID NO: 4,
  (iii) the mature polypeptide coding sequence of SEQ ID NO: 7,
  (iv) the mature polypeptide coding sequence of SEQ ID NO: 10,
  (v) the mature polypeptide coding sequence of SEQ ID NO: 13,
  (vi) the mature polypeptide coding sequence of SEQ ID NO: 16,
  (vii) the mature polypeptide coding sequence of SEQ ID NO: 25,
  (viii) the mature polypeptide coding sequence of SEQ ID NO: 28,
  (ix) the mature polypeptide coding sequence of SEQ ID NO: 37,
  (x) the mature polypeptide coding sequence of SEQ ID NO: 40,
  (xi) the mature polypeptide coding sequence of SEQ ID NO: 43,
  (xii) the mature polypeptide coding sequence of SEQ ID NO: 46,
  (xiii) the mature polypeptide coding sequence of SEQ ID NO: 65,
  (xiv) the mature polypeptide coding sequence of SEQ ID NO: 68,
  (xv) the mature polypeptide coding sequence of SEQ ID NO: 71,
  (xvi) the mature polypeptide coding sequence of SEQ ID NO: 74,
  (xvii) the mature polypeptide coding sequence of SEQ ID NO: 77,
  (xviii) the mature polypeptide coding sequence of SEQ ID NO: 80,
  (xix) the mature polypeptide coding sequence of SEQ ID NO: 83,
  (xx) the mature polypeptide coding sequence of SEQ ID NO: 86,
  (xxi) the mature polypeptide coding sequence of SEQ ID NO: 89,
  (xxii) the mature polypeptide coding sequence of SEQ ID NO: 92,
  (xxiii) the mature polypeptide coding sequence of SEQ ID NO: 95,
  (xxiv) the mature polypeptide coding sequence of SEQ ID NO: 98,
  (xxv) the mature polypeptide coding sequence of SEQ ID NO: 101,
  (xxvi) the mature polypeptide coding sequence of SEQ ID NO: 104,
  (xxvii) the mature polypeptide coding sequence of SEQ ID NO: 107,
  (xxviii) the mature polypeptide coding sequence of SEQ ID NO: 110,
  (xxix) the mature polypeptide coding sequence of SEQ ID NO: 113,
  (xxx) the mature polypeptide coding sequence of SEQ ID NO: 116,
  (xxxi) the mature polypeptide coding sequence of SEQ ID NO: 119,
  (xxxii) the mature polypeptide coding sequence of SEQ ID NO: 122,
  (xxxiii) the mature polypeptide coding sequence of SEQ ID NO: 125,
  (xxxiv) the mature polypeptide coding sequence of SEQ ID NO: 128,
  (xxxv) the full-length complementary strand of (i), (ii), (iii), (iv), (v), (vi), (vii), (viii), (ix), (x), (xi), (xii), (xiii), (xiv), (xv), (xvi), (xvii), (xviii), (xix), (xx), (xxi), (xxii), (xxiii), (xxiv), (xxv), (xxvi), (xxvii), (xxviii), (xxix), (xxx), (xxxi), (xxxii), (xxxiii) or (xxxiv);
(aj) a polypeptide encoded by a polynucleotide having at least 80% sequence identity to the mature polypeptide coding sequence of SEQ ID NO: 1 or SEQ ID NO: 4;
(ak) a polypeptide encoded by a polynucleotide having at least 80% sequence identity to the mature polypeptide coding sequence of SEQ ID NO: 7 or SEQ ID NO: 10;
(al) a polypeptide encoded by a polynucleotide having at least 80% sequence identity to the mature polypeptide coding sequence of SEQ ID NO: 13 or SEQ ID NO: 16;
(am) a polypeptide encoded by a polynucleotide having at least 80% sequence identity to the mature polypeptide coding sequence of SEQ ID NO: 25 or SEQ ID NO: 28;

(an) a polypeptide encoded by a polynucleotide having at least 80% sequence identity to the mature polypeptide coding sequence of SEQ ID NO: 37 or SEQ ID NO: 40;
(ao) a polypeptide encoded by a polynucleotide having at least 80% sequence identity to the mature polypeptide coding sequence of SEQ ID NO: 43 or SEQ ID NO: 46;
(ap) a polypeptide encoded by a polynucleotide having at least 80% sequence identity to the mature polypeptide coding sequence of SEQ ID NO: 65 or SEQ ID NO: 68;
(aq) a polypeptide encoded by a polynucleotide having at least 80% sequence identity to the mature polypeptide coding sequence of SEQ ID NO: 71 or SEQ ID NO: 74;
(ar) a polypeptide encoded by a polynucleotide having at least 80% sequence identity to the mature polypeptide coding sequence of SEQ ID NO: 77 or SEQ ID NO: 80;
(as) a polypeptide encoded by a polynucleotide having at least 80% sequence identity to the mature polypeptide coding sequence of SEQ ID NO: 83 or SEQ ID NO: 86;
(at) a polypeptide encoded by a polynucleotide having at least 80% sequence identity to the mature polypeptide coding sequence of SEQ ID NO: 89 or SEQ ID NO: 92;
(au) a polypeptide encoded by a polynucleotide having at least 80% sequence identity to the mature polypeptide coding sequence of SEQ ID NO: 95 or SEQ ID NO: 98;
(av) a polypeptide encoded by a polynucleotide having at least 80% sequence identity to the mature polypeptide coding sequence of SEQ ID NO: 101 or SEQ ID NO: 104;
(aw) a polypeptide encoded by a polynucleotide having at least 80% sequence identity to the mature polypeptide coding sequence of SEQ ID NO: 107 or SEQ ID NO: 110;
(ax) a polypeptide encoded by a polynucleotide having at least 80% sequence identity to the mature polypeptide coding sequence of SEQ ID NO: 113 or SEQ ID NO: 116;
(ay) a polypeptide encoded by a polynucleotide having at least 80% sequence identity to the mature polypeptide coding sequence of SEQ ID NO: 119 or SEQ ID NO: 122;
(az) a polypeptide encoded by a polynucleotide having at least 80% sequence identity to the mature polypeptide coding sequence of SEQ ID NO: 125 or SEQ ID NO: 128;
(ba) a variant of the polypeptide of SEQ ID NO: 3, SEQ ID NO: 6, SEQ ID NO: 9, SEQ ID NO: 12, SEQ ID NO: 15, SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130 or the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 26, SEQ ID NO: 29, SEQ ID NO: 38, SEQ ID NO: 41, SEQ ID NO: 44, SEQ ID NO: 47, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126 or SEQ ID NO: 129 comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions; and
(bb) a fragment of a polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag), (ah), (ai), (aj), (ak), (al), (am), (an), (ao), (ap), (aq), (ar), (as), (at), (au), (av), (aw), (ax), (ay), (az) or (ba) having at least 90% of the length of the mature polypeptide; or
(C) comprises the polypeptide of (B) wherein the polypeptide of (B) comprises one or more motifs of (A).

2. The method of item 1 wherein the polypeptide comprises or consists of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130.

3. The method of item 1 wherein the polypeptide comprises or consists of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 26, SEQ ID NO: 29, SEQ ID NO: 38, SEQ ID NO: 41, SEQ ID NO: 44, SEQ ID NO: 47, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126 or SEQ ID NO: 129.

4. The method of item 1 wherein the polypeptide comprises or consists of amino acids 1 to 537 of SEQ ID NO: 2, amino acids 1 to 546 of SEQ ID NO: 5, amino acids 1 to 547 of SEQ ID NO: 8, amino acids 1 to 555 of SEQ ID NO: 11, amino acids 1 to 598 of SEQ ID NO: 14, amino acids 1 to 606 of SEQ ID NO: 17, amino acids 1 to 550 of SEQ ID NO: 26, amino acids 1 to 558 of SEQ ID NO: 29, amino acids 1 to 828 of SEQ ID NO: 38, amino acids 1 to 836 of SEQ ID NO: 41, amino acids 1 to 577 of SEQ ID NO: 44 or amino acids 1 to 585 of SEQ ID NO: 47, amino acids 1 to 537 of SEQ ID NO: 66, amino acids 1 to 545 of SEQ ID NO: 69, amino acids 1 to 536 of SEQ ID NO: 72, amino acids 1 to 544 of SEQ ID NO: 75, amino acids 1 to 536 of SEQ ID NO: 78, amino acids 1 to 544 of SEQ ID NO: 81, amino acids 1 to 535 of SEQ ID NO: 84, amino acids 1 to 543 of SEQ ID NO: 87, amino acids 1 to 536 of SEQ ID NO: 90, amino acids 1 to 544 of SEQ ID NO: 93, amino acids 1 to 536 of SEQ ID NO: 96, amino acids 1 to 544 of SEQ ID NO: 99, amino acids 1 to 536 of SEQ ID NO: 102, amino acids 1 to 544 of SEQ ID NO: 105, amino acids 1 to 536 of SEQ ID NO: 108, amino acids 1 to 544 of SEQ ID NO: 111, amino acids 1 to 538 of SEQ ID NO: 114, amino acids 1 to 546 of SEQ ID NO: 117, amino acids 1 to 537 of SEQ ID NO: 120, amino acids 1 to 545 of SEQ ID NO: 123, amino acids 1 to 536 of SEQ ID NO: 126 or amino acids 1 to 544 of SEQ ID NO: 129.

5. The method of any of items 1 to 4 wherein the percentage solubilised xylose is at least 3% when the method is performed under the reaction conditions 10 mg GH5 polypeptide per kg defatted destarched maize (DFDSM) and incubation at 40° C., pH 5 for 4 hours.

6. An isolated polypeptide having xylanase activity, selected from the group consisting of:
(a) a polypeptide having at least 99.3% sequence identity to the polypeptide of SEQ ID NO: 3 or the mature polypeptide of SEQ ID NO: 2;
(b) a polypeptide having at least 99.3% sequence identity to the polypeptide of SEQ ID NO: 6 or the mature polypeptide of SEQ ID NO: 5;
(c) a polypeptide having at least 83% sequence identity to the polypeptide of SEQ ID NO: 9 or the mature polypeptide of SEQ ID NO: 8;
(d) a polypeptide having at least 83% sequence identity to the polypeptide of SEQ ID NO: 12 or the mature polypeptide of SEQ ID NO: 11;
(e) a polypeptide having at least 80% sequence identity to the polypeptide of SEQ ID NO: 15 or the mature polypeptide of SEQ ID NO: 14;
(f) a polypeptide having at least 80% sequence identity to the polypeptide of SEQ ID NO: 18 or the mature polypeptide of SEQ ID NO: 17;
(g) a polypeptide having at least 95% sequence identity to the polypeptide of SEQ ID NO: 27 or the mature polypeptide of SEQ ID NO: 26;
(h) a polypeptide having at least 95% sequence identity to the polypeptide of SEQ ID NO: 30 or the mature polypeptide of SEQ ID NO: 29;
(i) a polypeptide having at least 80% sequence identity to the polypeptide of SEQ ID NO: 39 or the mature polypeptide of SEQ ID NO: 38;
(j) a polypeptide having at least 80% sequence identity to the polypeptide of SEQ ID NO: 42 or the mature polypeptide of SEQ ID NO: 41;
(k) a polypeptide having at least 80% sequence identity to the polypeptide of SEQ ID NO: 45 or the mature polypeptide of SEQ ID NO: 44;
(l) a polypeptide having at least 80% sequence identity to the polypeptide of SEQ ID NO: 48 or the mature polypeptide of SEQ ID NO: 47;
(m) a polypeptide having at least 97.5% sequence identity to the polypeptide of SEQ ID NO: 67 or the mature polypeptide of SEQ ID NO: 66;
(n) a polypeptide having at least 97.5% sequence identity to the polypeptide of SEQ ID NO: 70 or the mature polypeptide of SEQ ID NO: 69;
(o) a polypeptide having at least 98.8% sequence identity to the polypeptide of SEQ ID NO: 73 or the mature polypeptide of SEQ ID NO: 72;
(p) a polypeptide having at least 98.8% sequence identity to the polypeptide of SEQ ID NO: 76 or the mature polypeptide of SEQ ID NO: 75;
(q) a polypeptide having at least 83% sequence identity to the polypeptide of SEQ ID NO: 79 or the mature polypeptide of SEQ ID NO: 78;
(r) a polypeptide having at least 83% sequence identity to the polypeptide of SEQ ID NO: 82 or the mature polypeptide of SEQ ID NO: 81;
(s) a polypeptide having at least 90% sequence identity to the polypeptide of SEQ ID NO: 85 or the mature polypeptide of SEQ ID NO: 84;
(t) a polypeptide having at least 90% sequence identity to the polypeptide of SEQ ID NO: 88 or the mature polypeptide of SEQ ID NO: 87;
(u) a polypeptide having at least 80% sequence identity to the polypeptide of SEQ ID NO: 91 or the mature polypeptide of SEQ ID NO: 90;
(v) a polypeptide having at least 80% sequence identity to the polypeptide of SEQ ID NO: 94 or the mature polypeptide of SEQ ID NO: 93;
(w) a polypeptide having at least 96% sequence identity to the polypeptide of SEQ ID NO: 97 or the mature polypeptide of SEQ ID NO: 96;
(x) a polypeptide having at least 96% sequence identity to the polypeptide of SEQ ID NO: 100 or the mature polypeptide of SEQ ID NO: 99;
(y) a polypeptide having at least 85% sequence identity to the polypeptide of SEQ ID NO: 103 or the mature polypeptide of SEQ ID NO: 102;
(z) a polypeptide having at least 85% sequence identity to the polypeptide of SEQ ID NO: 106 or the mature polypeptide of SEQ ID NO: 105;
(aa) a polypeptide having at least 82% sequence identity to the polypeptide of SEQ ID NO: 109 or the mature polypeptide of SEQ ID NO: 108;
(ab) a polypeptide having at least 82% sequence identity to the polypeptide of SEQ ID NO: 112 or the mature polypeptide of SEQ ID NO: 111;
(ac) a polypeptide having at least 96% sequence identity to the polypeptide of SEQ ID NO: 115 or the mature polypeptide of SEQ ID NO: 114;
(ad) a polypeptide having at least 96% sequence identity to the polypeptide of SEQ ID NO: 118 or the mature polypeptide of SEQ ID NO: 117;
(ae) a polypeptide having at least 96% sequence identity to the polypeptide of SEQ ID NO: 121 or the mature polypeptide of SEQ ID NO: 120;
(af) a polypeptide having at least 96% sequence identity to the polypeptide of SEQ ID NO: 124 or the mature polypeptide of SEQ ID NO: 123;
(ag) a polypeptide having at least 80% sequence identity to the polypeptide of SEQ ID NO: 127 or the mature polypeptide of SEQ ID NO: 126;
(ah) a polypeptide having at least 80% sequence identity to the polypeptide of SEQ ID NO: 130 or the mature polypeptide of SEQ ID NO: 129;
(ai) a polypeptide encoded by a polynucleotide that hybridizes under high stringency conditions, or very high stringency conditions with
(i) the mature polypeptide coding sequence of SEQ ID NO: 1,
(ii) the mature polypeptide coding sequence of SEQ ID NO: 4,
(iii) the mature polypeptide coding sequence of SEQ ID NO: 7,
(iv) the mature polypeptide coding sequence of SEQ ID NO: 10,
(v) the mature polypeptide coding sequence of SEQ ID NO: 13, (vi) the mature polypeptide coding sequence of SEQ ID NO: 16,
(vii) the mature polypeptide coding sequence of SEQ ID NO: 25,
(viii) the mature polypeptide coding sequence of SEQ ID NO: 28,
(ix) the mature polypeptide coding sequence of SEQ ID NO: 37,
(x) the mature polypeptide coding sequence of SEQ ID NO: 40,
(xi) the mature polypeptide coding sequence of SEQ ID NO: 43,
(xii) the mature polypeptide coding sequence of SEQ ID NO: 46,
(xiii) the mature polypeptide coding sequence of SEQ ID NO: 65,
(xiv) the mature polypeptide coding sequence of SEQ ID NO: 68,
(xv) the mature polypeptide coding sequence of SEQ ID NO: 71,
(xvi) the mature polypeptide coding sequence of SEQ ID NO: 74,
(xvii) the mature polypeptide coding sequence of SEQ ID NO: 77,
(xviii) the mature polypeptide coding sequence of SEQ ID NO: 80,
(xix) the mature polypeptide coding sequence of SEQ ID NO: 83,
(xx) the mature polypeptide coding sequence of SEQ ID NO: 86,
(xxi) the mature polypeptide coding sequence of SEQ ID NO: 89,
(xxii) the mature polypeptide coding sequence of SEQ ID NO: 92,
(xxiii) the mature polypeptide coding sequence of SEQ ID NO: 95,
(xxiv) the mature polypeptide coding sequence of SEQ ID NO: 98,
(xxv) the mature polypeptide coding sequence of SEQ ID NO: 101,
(xxvi) the mature polypeptide coding sequence of SEQ ID NO: 104,
(xxvii) the mature polypeptide coding sequence of SEQ ID NO: 107,
(xxviii) the mature polypeptide coding sequence of SEQ ID NO: 110,
(xxix) the mature polypeptide coding sequence of SEQ ID NO: 113,
(xxx) the mature polypeptide coding sequence of SEQ ID NO: 116,
(xxxi) the mature polypeptide coding sequence of SEQ ID NO: 119,
(xxxii) the mature polypeptide coding sequence of SEQ ID NO: 122,
(xxxiii) the mature polypeptide coding sequence of SEQ ID NO: 125,
(xxxiv) the mature polypeptide coding sequence of SEQ ID NO: 128,
(xxxv) the full-length complementary strand of (i), (ii), (iii), (iv), (v), (vi), (vii), (viii), (ix), (x), (xi), (xii), (xiii), (xiv), (xv), (xvi), (xvii), (xviii), (xix), (xx), (xxi), (xxii), (xxiii), (xxiv), (xxv), (xxvi), (xxvii), (xxviii), (xxix), (xxx), (xxxi), (xxxii), (xxxiii) or (xxxiv);

(aj) a polypeptide encoded by a polynucleotide having at least 99.3% sequence identity to the mature polypeptide coding sequence of SEQ ID NO: 1 or SEQ ID NO: 4;
(ak) a polypeptide encoded by a polynucleotide having at least 83% sequence identity to the mature polypeptide coding sequence of SEQ ID NO: 7 or SEQ ID NO: 10;
(al) a polypeptide encoded by a polynucleotide having at least 80% sequence identity to the mature polypeptide coding sequence of SEQ ID NO: 13 or SEQ ID NO: 16;
(am) a polypeptide encoded by a polynucleotide having at least 95% sequence identity to the mature polypeptide coding sequence of SEQ ID NO: 25 or SEQ ID NO: 28;
(an) a polypeptide encoded by a polynucleotide having at least 80% sequence identity to the mature polypeptide coding sequence of SEQ ID NO: 37 or SEQ ID NO: 40;
(ao) a polypeptide encoded by a polynucleotide having at least 80% sequence identity to the mature polypeptide coding sequence of SEQ ID NO: 43 or SEQ ID NO: 46;
(ap) a polypeptide encoded by a polynucleotide having at least 97.5% sequence identity to the mature polypeptide coding sequence of SEQ ID NO: 65 or SEQ ID NO: 68;
(aq) a polypeptide encoded by a polynucleotide having at least 98.8% sequence identity to the mature polypeptide coding sequence of SEQ ID NO: 71 or SEQ ID NO: 74;
(ar) a polypeptide encoded by a polynucleotide having at least 83% sequence identity to the mature polypeptide coding sequence of SEQ ID NO: 77 or SEQ ID NO: 80;
(as) a polypeptide encoded by a polynucleotide having at least 90% sequence identity to the mature polypeptide coding sequence of SEQ ID NO: 83 or SEQ ID NO: 86;
(at) a polypeptide encoded by a polynucleotide having at least 80% sequence identity to the mature polypeptide coding sequence of SEQ ID NO: 89 or SEQ ID NO: 92;
(au) a polypeptide encoded by a polynucleotide having at least 96% sequence identity to the mature polypeptide coding sequence of SEQ ID NO: 95 or SEQ ID NO: 98;
(av) a polypeptide encoded by a polynucleotide having at least 85% sequence identity to the mature polypeptide coding sequence of SEQ ID NO: 101 or SEQ ID NO: 104;
(aw) a polypeptide encoded by a polynucleotide having at least 82% sequence identity to the mature polypeptide coding sequence of SEQ ID NO: 107 or SEQ ID NO: 110;
(ax) a polypeptide encoded by a polynucleotide having at least 96% sequence identity to the mature polypeptide coding sequence of SEQ ID NO: 113 or SEQ ID NO: 116;
(ay) a polypeptide encoded by a polynucleotide having at least 96% sequence identity to the mature polypeptide coding sequence of SEQ ID NO: 119 or SEQ ID NO: 122;
(az) a polypeptide encoded by a polynucleotide having at least 80% sequence identity to the mature polypeptide coding sequence of SEQ ID NO: 125 or SEQ ID NO: 128;
(ba) a variant of the polypeptide of SEQ ID NO: 3, SEQ ID NO: 6 or the mature polypeptide of SEQ ID NO: 2 or SEQ ID NO: 5 wherein the variant has xylanase activity and comprises one or more amino acid substitutions, and/or one or more amino acid deletions, and/or one or more amino acid insertions or any combination thereof in 1, 2, 3 or 4 positions;

(bb) a variant of the polypeptide of SEQ ID NO: 27, SEQ ID NO: 30 or the mature polypeptide of SEQ ID NO: 26 or SEQ ID NO: 29 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26 or 27 positions;

(bc) a variant of the polypeptide of SEQ ID NO: 67, SEQ ID NO: 70 or the mature polypeptide of SEQ ID NO: 66 or SEQ ID NO: 69 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13 or 14 positions;

(bd) a variant of the polypeptide of SEQ ID NO: 73, SEQ ID NO: 76 or the mature polypeptide of SEQ ID NO: 72 or SEQ ID NO: 75 wherein the variant has xylanase activity and comprises one or more amino acid substitutions, and/or one or more amino acid deletions, and/or one or more amino acid insertions or any combination thereof in 1, 2, 3, 4, 5 or 6 positions;

(be) a variant of the polypeptide of SEQ ID NO: 97, SEQ ID NO: 100, SEQ ID NO: 115, SEQ ID NO: 118, SEQ ID NO: 121, SEQ ID NO: 124 or the mature polypeptide of SEQ ID NO: 96, SEQ ID NO: 99, SEQ ID NO: 114, SEQ ID NO: 117, SEQ ID NO: 120 or SEQ ID NO: 123 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20 or 21 positions;

(bf) a variant of the polypeptide of SEQ ID NO: 9, SEQ ID NO: 12, SEQ ID NO: 15, SEQ ID NO: 18, SEQ ID NO: 39, SEQ ID NO: 42, SEQ ID NO: 45, SEQ ID NO: 48, SEQ ID NO: 79, SEQ ID NO: 82, SEQ ID NO: 85, SEQ ID NO: 88, SEQ ID NO: 91, SEQ ID NO: 94, SEQ ID NO: 103, SEQ ID NO: 106, SEQ ID NO: 109, SEQ ID NO: 112, SEQ ID NO: 127, SEQ ID NO: 130 or the mature polypeptide of SEQ ID NO: 8, SEQ ID NO: 11, SEQ ID NO: 14, SEQ ID NO: 17, SEQ ID NO: 32, SEQ ID NO: 35, SEQ ID NO: 38, SEQ ID NO: 41, SEQ ID NO: 44 or SEQ ID NO: 47, SEQ ID NO: 78, SEQ ID NO: 81, SEQ ID NO: 84, SEQ ID NO: 87, SEQ ID NO: 90, SEQ ID NO: 93, SEQ ID NO: 102, SEQ ID NO: 105, SEQ ID NO: 108, SEQ ID NO: 111, SEQ ID NO: 126 or SEQ ID NO: 129 wherein the variant has xylanase activity and comprises one or more amino acid substitutions, and/or one or more amino acid deletions, and/or one or more amino acid insertions or any combination thereof in 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 positions; and (bg) a fragment of a polypeptide of (a), (b), (c), (d), (e), (f), (g), (h), (i), (j), (k), (l), (m), (n), (o), (p), (q), (r), (s), (t), (u), (v), (w), (x), (y), (z), (aa), (ab), (ac), (ad), (ae), (af), (ag), (ah), (ai), (aj), (ak), (al), (am), (an), (ao), (ap), (aq), (ar), (as), (at), (au), (av), (aw), (ax), (ay), (az), (ba), (bb), (bc), (bd), (be) or (bf) having xylanase activity and having at least 90% of the length of the mature polypeptide.

7. The polypeptide of item 6, wherein the polypeptide comprises or consists of SEQ ID NO: 3, SEQ ID NO: 6, SEQ ID NO: 9, SEQ ID NO: 12, SEQ ID NO: 15 or SEQ ID NO: 18, SEQ ID NO: 27, SEQ ID NO: 30, SEQ ID NO: 39, SEQ ID NO: 42, SEQ ID NO: 45, SEQ ID NO: 48, SEQ ID NO: 67, SEQ ID NO: 70, SEQ ID NO: 73, SEQ ID NO: 76, SEQ ID NO: 79, SEQ ID NO: 82, SEQ ID NO: 85, SEQ ID NO: 88, SEQ ID NO: 91, SEQ ID NO: 94, SEQ ID NO: 97, SEQ ID NO: 100, SEQ ID NO: 103, SEQ ID NO: 106, SEQ ID NO: 109, SEQ ID NO: 112, SEQ ID NO: 115, SEQ ID NO: 118, SEQ ID NO: 121, SEQ ID NO: 124, SEQ ID NO: 127 or SEQ ID NO: 130.

8. The polypeptide of item 6, wherein the polypeptide comprises or consists of the mature polypeptide of SEQ ID NO: 2, SEQ ID NO: 5, SEQ ID NO: 8, SEQ ID NO: 11, SEQ ID NO: 14, SEQ ID NO: 17, SEQ ID NO: 26, SEQ ID NO: 29, SEQ ID NO: 38, SEQ ID NO: 41, SEQ ID NO: 44, SEQ ID NO: 47, SEQ ID NO: 66, SEQ ID NO: 69, SEQ ID NO: 72, SEQ ID NO: 75, SEQ ID NO: 78, SEQ ID NO: 81, SEQ ID NO: 84, SEQ ID NO: 87, SEQ ID NO: 90, SEQ ID NO: 93, SEQ ID NO: 96, SEQ ID NO: 99, SEQ ID NO: 102, SEQ ID NO: 105, SEQ ID NO: 108, SEQ ID NO: 111, SEQ ID NO: 114, SEQ ID NO: 117, SEQ ID NO: 120, SEQ ID NO: 123, SEQ ID NO: 126 or SEQ ID NO: 129.

9. The polypeptide of item 6, wherein the polypeptide comprises or consists of amino acids 1 to 537 of SEQ ID NO: 2, amino acids 1 to 546 of SEQ ID NO: 5, amino acids 1 to 547 of SEQ ID NO: 8, amino acids 1 to 555 of SEQ ID NO: 11, amino acids 1 to 598 of SEQ ID NO: 14, amino acids 1 to 606 of SEQ ID NO: 17, amino acids 1 to 550 of SEQ ID NO: 26, amino acids 1 to 558 of SEQ ID NO: 29, amino acids 1 to 828 of SEQ ID NO: 38, amino acids 1 to 836 of SEQ ID NO: 41, amino acids 1 to 577 of SEQ ID NO: 44 or amino acids 1 to 585 of SEQ ID NO: 47, amino acids 1 to 537 of SEQ ID NO: 66, amino acids 1 to 545 of SEQ ID NO: 69, amino acids 1 to 536 of SEQ ID NO: 72, amino acids 1 to 544 of SEQ ID NO: 75, amino acids 1 to 536 of SEQ ID NO: 78, amino acids 1 to 544 of SEQ ID NO: 81, amino acids 1 to 535 of SEQ ID NO: 84, amino acids 1 to 543 of SEQ ID NO: 87, amino acids 1 to 536 of SEQ ID NO: 90, amino acids 1 to 544 of SEQ ID NO: 93, amino acids 1 to 536 of SEQ ID NO: 96, amino acids 1 to 544 of SEQ ID NO: 99, amino acids 1 to 536 of SEQ ID NO: 102, amino acids 1 to 544 of SEQ ID NO: 105, amino acids 1 to 536 of SEQ ID NO: 108, amino acids 1 to 544 of SEQ ID NO: 111, amino acids 1 to 538 of SEQ ID NO: 114, amino acids 1 to 546 of SEQ ID NO: 117, amino acids 1 to 537 of SEQ ID NO: 120, amino acids 1 to 545 of SEQ ID NO: 123, amino acids 1 to 536 of SEQ ID NO: 126 or amino acids 1 to 544 of SEQ ID NO: 129.

10. A composition comprising the polypeptide of any of items 6 to 9 and a formulating agent.

11. The composition of item 10 wherein the formulating agent comprises one or more of the following compounds: glycerol, ethylene glycol, 1, 2-propylene glycol or 1, 3-propylene glycol, sodium chloride, sodium benzoate, potassium sorbate, sodium sulfate, potassium sulfate, magnesium sulfate, sodium thiosulfate, calcium carbonate, sodium citrate, dextrin, glucose, sucrose, sorbitol, lactose, starch and cellulose.

12. The composition of any of items 10 to 11 further comprising one or more additional enzymes.

13. The composition of item 12, wherein the one or more additional enzymes is selected from the group consisting of phytase, xylanase, galactanase, alpha-galactosidase, protease, phospholipase A1, phospholipase A2, lysophospholipase, phospholipase C, phospholipase D, amylase, lysozyme, arabinofuranosidase, beta-xylosidase, acetyl xylan esterase, feruloyl esterase, cellulase, cellobiohydrolases, beta-glucosidase, pullulanase, and beta-glucanase or any combination thereof.

14. The composition of any of items 10 to 13 further comprising one or more microbes.

15. The composition of item 14, wherein the one or more microbes is selected from the group consisting of *Bacillus subtilis, Bacillus licheniformis, Bacillus amyloliquefaciens, Bacillus cereus, Bacillus pumilus, Bacillus polymyxa, Bacillus megaterium, Bacillus coagulans, Bacillus circulans, Bifidobacterium bifidum, Bifidobacterium animalis, Bifidobacterium* sp., *Carnobacterium* sp., *Clostridium butyricum, Clostridium* sp., *Enterococcus faecium, Enterococcus* sp., *Lactobacillus* sp., *Lactobacillus acidophilus, Lactobacillus farciminus, Lactobacillus rhamnosus, Lactobacillus reuteri, Lactobacillus salivarius, Lactococcus lactis, Lactococcus* sp., *Leuconostoc* sp., *Megasphaera elsdenii, Megasphaera* sp., *Pediococcus acidilactici, Pediococcus* sp., *Propionibacterium thoenii, Propionibacterium* sp. and *Streptococcus* sp. or any combination thereof.

16. The composition of any of items 10 to 15 further comprising plant based material from the sub-family Panicoideae.

17. The composition of item 16, wherein the plant based material from the sub-family Panicoideae is maize, corn, *sorghum*, switchgrass, millet, pearl millet, foxtail millet or in a processed form such as milled corn, milled maize, defatted maize, defatted destarched maize, milled *sorghum*, milled switchgrass, milled millet, milled foxtail millet, milled pearl millet, or any combination thereof.

18. The composition of any of items 16 to 17, wherein the plant based material from the sub-family Panicoideae is from the seed fraction (such as endosperm and/or husk) of the plant.

19. An animal feed additive comprising the polypeptide of any of items 6 to 9 or the composition of any of items 10 to 18 and one or more components selected from the list consisting of:
one or more vitamins;
one or more minerals;
one or more amino acids; and
one or more other feed ingredients.

20. An animal feed comprising the polypeptide of any of items 6 to 9, the composition of any of items 10 to 15 or the animal feed additive of item 19 and plant based material from the sub-family Panicoideae.

21. The animal feed of item 20, wherein the plant based material from the sub-family Panicoideae is maize, corn, *sorghum*, switchgrass, millet, pearl millet, foxtail millet or in a processed form such as milled corn, milled maize, defatted maize, defatted destarched maize, milled *sorghum*, milled switchgrass, milled millet, milled foxtail millet, milled pearl millet, or any combination thereof.

22. The animal feed of any of items 20 to 21, wherein the plant based material from the sub-family Panicoideae is from the seed fraction (such as endosperm and/or husk) of the plant.

23. A method of improving the performance of an animal comprising administering to the animal plant based material from the sub-family Panicoideae together with the polypeptide of any of items 6 to 9, the composition of any of items 10 to 15 or the animal feed additive of item 19, such that the plant based material from the sub-family Panicoideae is added together or separately with the GH5 polypeptide having xylanase activity.

24. The method of item 23, wherein improving the performance of an animal means improved body weight gain, improved European Production Efficiency Factor (EPEF) and/or improved FCR.

25. A method of preparing an animal feed comprising mixing the polypeptide of any of items 6 to 9, the composition of any of items 10 to 15 or the animal feed additive of item 19 with plant based material from the sub-family Panicoideae.

26. A method for improving the nutritional value of plant material from the sub-family Panicoideae comprising treating plant material from the sub-family Panicoideae with the polypeptide of any of items 6 to 9, the composition of any of items 10 to 15 or the animal feed additive of item 19.

27. A method for improving the nutritional value of an animal feed, comprising treating the animal feed comprising plant based material from the sub-family Panicoideae with the polypeptide of any of items 6 to 9, the composition of any of items 10 to 15 or the animal feed additive of item 19.

28. A method of releasing starch from plant based material, comprising treating plant based material from the sub-family Panicoideae with the polypeptide of any of items 6 to 9, the composition of any of items 10 to 15 or the animal feed additive of item 19.

29. The method of any of items 23 to 28, wherein the plant based material from the sub-family Panicoideae is maize, corn, *sorghum*, switchgrass, millet, pearl millet, foxtail millet or in a processed form such as milled corn, milled maize, defatted maize, defatted destarched maize, milled *sorghum*, milled switchgrass, milled millet, milled foxtail millet, milled pearl millet, or any combination thereof.

30. The method of any of items 23 to 29, wherein the plant based material from the sub-family Panicoideae is from the seed fraction (such as endosperm and/or husk) of the plant.

31. A polynucleotide encoding the polypeptide of any of items 6 to 9.

32. A nucleic acid construct or expression vector comprising the polynucleotide of item 31 operably linked to one or more control sequences that direct the production of the polypeptide in an expression host.

33. A recombinant host cell comprising the polynucleotide of item 31 operably linked to one or more control sequences that direct the production of the polypeptide.

34. A method of producing the polypeptide of any of items 6 to 9, comprising:
(a) cultivating a cell, which in its wild-type form produces the polypeptide, under conditions conductive for production of the polypeptide; and
(b) recovering the polypeptide.

35. A method of producing the polypeptide of any of items 6 to 9, comprising:
(a) cultivating a host cell of item 33 under conditions conducive for production of the polypeptide; and
(b) recovering the polypeptide.

36. A transgenic plant, plant part or plant cell transformed with a polynucleotide encoding the polypeptide of any of items 6 to 9.

37. A whole broth formulation or cell culture composition comprising a polypeptide of any of items 6 to 9.

38. Use of polypeptide of any of items 6 to 9, the composition of any of items 10 to 15 or the animal feed additive of item 19:
  in animal feed;
  in animal feed additives;
  in the preparation of a composition for use in animal feed;
  for improving the nutritional value of an animal feed;
  for increasing digestibility of the animal feed;
  for improving one or more performance parameters in an animal;
  for releasing xylose from plant based material of the sub-family Panicoideae; and/or
  for releasing starch from plant based material of the sub-family Panicoideae.

The present invention is further described by the following examples that should not be construed as limiting the scope of the invention.

EXAMPLES

Strains

The elephant dung was obtained from a six years old female Asian elephant (name "Kandy") living in the zoological garden in Hamburg, Germany. The DNA isolation was performed with the QIAamp DNA Stool kit from Qiagen (Hilden, Germany) as described in the manufacturer's protocol. The GH5 xylanase sequences (SEQ ID NO: 13, 31, 37 and 43 giving the deduced polypeptide sequence SEQ ID NO: 14, 32, 38 and 44 respectively) were obtained by deep sequencing of the metagenome extract.

The compost metagenome was obtained from a rice-straw enriched compost microbial community from Berkeley, Calif., USA in 2011 (GOLD Analysis Project ID: Ga0026259). The DNA isolation was performed with the QIAamp DNA Stool kit from Qiagen (Hilden, Germany) as described in the manufacturer's protocol. The GH5 xylanase sequences (SEQ ID NO: 125 giving the deduced polypeptide sequence SEQ ID NO: 126) were obtained by deep sequencing of the metagenome extract.

Genome sequencing, the subsequent assembly of reads and the gene discovery (i.e. annotation of gene functions) is known to the person skilled in the art and the service can be purchased commercially.

The sources of other bacterial strains are listed in table 2.

TABLE 2

Isolation of bacterial strains

| Strain | Source | Country | Year | SEQ ID NO of gene | SEQ ID NO of polypeptide |
|---|---|---|---|---|---|
| Paenibacillus illinoisensis | Thermal sample | New Zealand | 1991 | 1 | 2 |
| Paenibacillus sp-18054 | Thermal sample | New Zealand | 1991 | 7 | 8 |
| Chryseobacterium sp-10696 | Minced fish muscle in water | — | On or before 1965 | 25 | 26 |
| Paenibacillus campinasensis | Mud sample | Denmark | 1999 | 65 | 66 |
| Paenibacillus sp-62250 | Forest soil | United States | 2012 | 71 | 72 |
| Paenibacillus favisporus | Soil | Denmark | 2011 | 77 | 78 |
| Paenibacillus tundra | Humus | Greenland | 1989 | 83 | 84 |
| Paenibacillus sp-62603 | Rootzone | Sweden | 2013 | 89 | 90 |

TABLE 2-continued

Isolation of bacterial strains

| Strain | Source | Country | Year | SEQ ID NO of gene | SEQ ID NO of polypeptide |
|---|---|---|---|---|---|
| Paenibacillus sp-19179 | Manure | Denmark | 2013 | 95 | 96 |
| Paenibacillus sp-62332 | Soil | United States | 2012 | 101 | 102 |
| Paenibacillus sp-62248 | Soil | United States | 2012 | 107 | 108 |
| Paenibacillus xylanexedens | Soil | Denmark | 2011 | 113 | 114 |
| Paenibacillus chitinolyticus | Rootzone | Sweden | 2013 | 119 | 120 |

[1]Obtained from NCIMB Ltd, Aberdeen, Scotland as NCIMB1314 deposited under the name *Flavobacterium* sp.

Media and Solutions
Preparation of Destarched Maize (DSM)

107 kg of milled maize (<10 mm) was mixed in a tank with 253 kg of tap water at 53° C. to make a slurry. The temperature of the slurry was 47° C. and the pH 5.9. The pH was adjusted to 6.15 with 1 L of 1 N NaOH and the tank was then heated to 95° C. 1.119 kg of Termamyl® alpha-amylase (Novozymes A/S, Bagsvaerd, Denmark) was added at 52° C. and incubated for 80 minutes at 95° C. The pH measured at the end of the incubation was 6.17. Cold tap water was added to the slurry and the slurry was centrifuged and decanted 3 times using a Westfalia decanter CA-225-110 (4950±10 rpm, flow ~6001/h) giving 64.5 kg of sludge. The sludge was then collected, frozen and freeze-dried to give 17.1 kg of destarched maize (DSM).

Preparation of Defatted Destarched Maize (DFDSM)

500 mL acetone was added to 100 gram of destarched maize, prepared as described above. The slurry was stirred for 5 minutes and allowed to settle. The acetone was decanted and the procedure was repeated 2 times. The residue was air dried overnight to give defatted destarched maize (DFDSM) which was stored at room temperature.

Preparation of Destarched *Sorghum*

Whole *sorghum* seeds were milled and sieved and a fraction below 0.5 mm was used for further processing. The sieved fraction was suspended in 25 mM NaOAc pH 5.5 at 20% dry matter and destarched. The destarching involved a first step at 85° C. with 500 ppm Termamyl SC alpha-amylase (Novozymes A/S, Bagsvaerd, Denmark) for 20 min followed by an overnight incubation using 250 ppm Attenuzyme Flex (Novozymes A/S, Bagsvaerd, Denmark) at 65° C. The slurry was centrifuged and the liquid decanted. After this another destarching was made using by adding MilliQ water and 200 ppm Termamyl SC and 200 ppm Attenuzyme Flex and incubating overnight at 65° C.

The *sorghum* fiber was separated from the liquid by vacuum filtration through a Whatman F glass fiber filter. The filter cake was then washed several times with excess of water to remove soluble sugars. Finally the destarched *sorghum* fiber was dried in an oven at 65° C. and the dry fiber milled quickly in a coffee grinder so that the particle size was in general less than 1 mm.

Assays
Xylose Assay

A xylose standard curve from 0 to 125 µg xylose/mL was prepared from a stock solution of 2.5 mg xylose/mL (prepared by dissolving 0.125 g xylose in 50 mL de-ionised water).

Assay Principle.

The interconversion of the α- and β-anomeric forms of D-xylose is catalysed by xylose mutarotase (XMR) using the D-xylose assay kit from Megazyme International Ireland. The β-D-xylose is oxidised by NAD+ to D-xylonic acid in the presence of β-xylose dehydrogenase (β-XDH) at pH 7.5. The amount of NADH formed in this reaction is stoichiometric with the amount of D-xylose and is measured by the increase in absorbance at 340 nm.

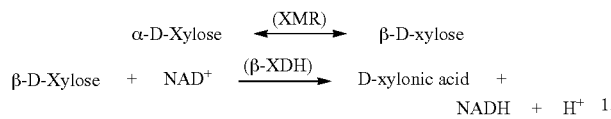

Example 1: Cloning of GH5 Xylanases

Codon optimized synthetic genes based on the nucleotide sequences SEQ ID NO: 13, 77, 119 and 125 were synthesized and purchased commercially. For the *Paenibacillus* species (SEQ ID NO: 1, 7, 65, 71, 83, 89, 95, 101, 107, 113), the *Chryseobacterium* species (SEQ ID NO: 25) as well as the elephant genome sequences SEQ ID NO: 31, 37 and 43, the wild type sequences were cloned.

The xylanases were cloned into a *Bacillus* expression vector as described in WO 12/025577. The DNA encoding the mature xylanase peptide were cloned in frame to a *Bacillus clausii* secretion signal (BcSP; with the following amino acid sequence: MKKPLGKIVASTALLISVAFSS-SIASA (SEQ ID NO: 22), originating from the protease AprH of *B. clausii*). BcSP replaced all native secretion signals respectively in all genes.

Downstream of the BcSP sequence an affinity tag sequence was introduced to ease the purification process (His-tag; with the following amino acid sequence: HHHH-HHPR (SEQ ID NO: 23) for the xylanases from elephant dung metagenome, compost metagenome, *Chryseobacterium* sp-10696, *Paenibacillus* sp. 18054, *Paenibacillus campinasensis*, *Paenibacillus* sp-62250, *Paenibacillus favisporus*, *Paenibacillus tundra*, *Paenibacillus* sp-62603, *Paenibacillus* sp-19179, *Paenibacillus* sp-62332, *Paenibacillus* sp-62248, *Paenibacillus xylanexedens*, *Paenibacillus chitinolyticus*; HQ-tag, with the following amino acid sequence: HQHQHQHPR (SEQ ID NO: 24) for the *Paenibacillus illinoisensis* xylanase). The gene that was expressed therefore comprised the BcSP sequence followed by the His- or HQ-tag sequence followed by the mature wild type xylanase sequence (as shown in SEQ ID NO: 4, 10, 16, 28, 34, 40, 46, 68, 74, 80, 86, 92, 98, 104, 110, 116, 122 and 128).

The final expression plasmids (BcSP-His-tag-xylanase or BcSP-HQ-tag-xylanase) were individually transformed into a *Bacillus subtilis* expression host. The xylanase BcSP-fusion genes were integrated by homologous recombination into the *Bacillus subtilis* host cell genome upon transformation.

The gene construct was expressed under the control of a triple promoter system (as described in WO 99/43835). The gene coding for chloramphenicol acetyltransferase was used as maker (as described in Diderichsen et al., 1993, *Plasmid* 30: 312-315). Transformants were selected on LB media agar supplemented with 6 microgram of chloramphenicol per ml. One recombinant *Bacillus subtilis* clone containing the respective xylanase expression construct was selected and was cultivated on a rotary shaking table in 500 ml baffled Erlenmeyer flasks each containing 100 ml yeast extract-based media. After 3-5 days cultivation time at 30° C. to 37° C., enzyme containing supernatants were harvested by centrifugation and the enzymes were purified by His-tag or HQ-tag purification.

Example 2: Purification of GH5 Xylanases

All His-tagged enzymes were purified by immobilized metal chromatography (IMAC) using $Ni^{2+}$ as the metal ion on 5 mL HisTrap Excel columns (GE Healthcare Life Sciences). The purification took place at pH 8 and the bound proteins were eluted with 50 mM HEPES, pH7.0 and 0.75 M imidazole. Subsequently, the enzyme sample was desalted by loading onto a Sephadex™ G-25 (medium) (GE Healthcare, Piscataway, N.J., USA) column equilibrated in 50 mM HEPES pH 7.0, 100 mM NaCl and eluting with the same buffer. The purity of the purified enzymes was checked by SDS-PAGE and the concentration of each enzyme determined by Abs 280 nm after a buffer exchange.

Example 3: Measurement of Soluble and Insoluble Dietary Fiber in the Substrate Defatted De-Starched Maize (DFDSM) and Correlation to Soluble Xylose Measured after Enzymatic Incubation 400 mg of defatted de-starched maize (DFDSM) was added to NaOAc-buffer (5 mL, pH 5). The mixture was heated to between 90-100° C., then Termamyl 300 DX (100 µL, Novozymes NS, Bagsvaerd, Denmark) was added and the mixture was incubated for 1 hr. The mixture was then cooled and amyloglucosidase from *Aspergillus niger* (500 µL, catalogue number E-AMGDF, for use in Megazyme Total Starch and Dietary Fiber, Megazyme International Ireland, Wicklow, Ireland) was added and samples were incubated overnight (16 h) at 60° C. The mixture was then cooled and centrifuged at 2500×g for 10 min at 5° C. The supernatant was collected and NaOAc-buffer (5 mL, pH 5) was added to the residue and centrifuged at 2500×g, 10 min, 5° C. This procedure was repeated twice. The supernatants were then collected, pooled and analysed for soluble NSP as described in A. The residue was analysed for insoluble NSP as described in B.

A: Soluble NSP, Supernatant

The pooled supernatants were diluted to a fixed volume from which a 5 mL aliquot of supernatant was taken. To this aliquot was added 20.1 mL cold 99.9% ethanol and the mixture was kept on ice for approx. 15 min for precipitation of polymers with a DP>10. After centrifuging at 2500×g, 5° C. for 10 min, the supernatant was discarded.

5 mL cold 80% ethanol was added to the pellet and the mixture was kept on ice for approx. 15 min. After centrifuging at 2500×g, 5° C. for 10 min, the supernatant was discarded.

Acid hydrolysis of the precipitate was conducted by the addition of MQ water (7.9 mL), myoinositol (0.5 mL, internal standard) and 12M $H_2SO_4$ (0.3 mL) and autoclaving at 125° C. for 55 minutes.

B: Insoluble NSP, Residue

The pellet obtained after AMG treatment was hydrolysed by the addition of MQ water (74 mL), myoinositol (10 mL, internal standard) and 12M $H_2SO_4$ (3 mL) and autoclaving at 125° C. for 55 minutes.

GLC Analysis

After autoclaving, the samples were reduced with borohydride to produce alditol sugars and these were derivatised by acetylation to become volatile for GLC analyses on an instrument with FID detector (Pettersson et al, (1995) "Total dietary fiber determined as neutral sugar residues, uronic acid residues, and Klason lignin (the Uppsala method), Collaborative study", *J. AOAC Int.* 78:1030-1044). The concentration of the soluble or insoluble sugars was determined relative to myo-inositiol.

Percentage Solubilised Xylose

When DFDSM is incubated with enzyme at 40° C. for 4 hours, the enzyme solubilizes the xylan in the substrate and this solubilized xylan is then hydrolysed further by acid. The xylose released is measured spectrophotometrically using a D-xylose assay kit (Megazyme, catalogue number K-xylose). This xylose (which is actually enzyme solubilized xylan) is then correlated to the amount of total xylose of the substrate measured by GLC as described above.

The DFDSM contains 99% insoluble and 1% soluble xylose, in total 14.81% xylose which represents the concentration of xylose polymer (DP>10) present in the sample (DFDSM) according to the analysis. Based on the release of xylose measured by the Megazyme kit which calculates release based on sample weight, the amount of xylose released can be calculated as follows: e.g. 1% release from 400 mg of sample equals 4 mg of xylose. In 400 mg sample there is 400 mg×14.81% xylose, equal to 59.22 mg xylose. The gross xylose (insoluble+soluble) release is that case 4 mg/59.22 mg which represents a release of 6.75% of total xylose polymers, but it should be noted that this value must be corrected for the passive release obtained for the non-enzyme supplemented control. This corrected value is defined herein as the percentage solubilised xylose.

Example 4: Hydrolysis of Defatted Destarched Maize (DFDSM) with GH5 Xylanases Defatted destarched maize (DFDSM, 400 mg) was added to aqueous sodium acetate (0.1 M, 3.9 mL) solution containing calcium chloride (5 mM) at pH 5 and the mixture heated to 40° C. for 30 minutes. 100 µL buffer or enzyme solution was added and the sample was heated at 40° C. for 4 hours. The sample was cooled to 5° C. and centrifuged (4000 rpm, 5° C.) for 10 minutes. 1.7 mL of the sample was transferred to an Eppendorf tube and the enzyme deactivated by heating to 95° C. for 10 minutes. The samples were then frozen until hydrolyzed.

The supernatant was thawed and centrifuged (14000 rpm) for 5 minutes. The supernatant (250 µL) was diluted with Milli-Q water (250 µL) in glass tubes and HCl (1.63 M, 2.0 mL) was added. The reaction was heated to 100° C. for 1 hour then cooled in an ice bath. Aqueous NaOH solution (1.3 M, 2.5 mL) was added whilst the samples were cooled on ice and the samples were stored at 0-5° C. whilst xylose content was analysed using the xylose assay. The results are presented in tables 3, 4, 5, 6 and 7.

TABLE 3

Xylose release from DFDSM using GH5 xylanase SEQ ID NO: 6

Table 3 shows the amount of xylose measured after acid hydrolysis of supernatants (% of dry matter and % solubilized xylose of total xylose) when incubating defatted de-starched maize (DFDSM) with the GH5 xylanase of SEQ ID NO: 6 at different enzyme concentrations compared to blank and the commercial GH11 xylanase Ronoxyme WX.

| GH5 Xylanase | Conc. [mg EP/kg] | Soluble xylose (%) | % solubilised xylose[1] | Significance[2] | Std. Dev. |
|---|---|---|---|---|---|
| Blank | 0 | 0.039 | 0.3 | C | 0.004 |
| Ronoxyme WX (GH11) | 25 | 0.101 | 0.7 | C | 0.009 |
| SEQ ID NO: 6 | 10 | 0.903 | 6.2 | B | 0.116 |
| SEQ ID NO: 6 | 25 | 1.295 | 9.0 | A | 0.225 |
| SEQ ID NO: 6 | 50 | 1.200 | 8.2 | A | 0.133 |

[1]Percentage solubilised xylose was calculated as described in example 3.
[2]ABC: Least squared values within a column not sharing a capital letter differ significantly (P < 0.05 all pairs Tukey-Kramer HSD).

TABLE 4

Xylose release from DFDSM using GH5 xylanase SEQ ID NO: 12

Table 4 shows the amount of xylose measured after acid hydrolysis of supernatants (% of dry matter and % solubilized xylose of total xylose) when incubating defatted de-starched maize (DFDSM) with the GH5 xylanase of SEQ ID NO: 12 at different enzyme concentrations compared to blank and the commerical GH11 xylanase Ronoxyme WX.

| GH5 Xylanase | Conc. [mg EP/kg] | Soluble xylose (%) | % solubilised xylose[1] | Significance[2] | Std. Dev. |
|---|---|---|---|---|---|
| Blank | 0 | 0.040 | 0.3 | C | 0.001 |
| Ronoxyme WX (GH11) | 25 | 0.101 | 0.7 | C | 0.010 |
| SEQ ID NO: 12 | 10 | 0.890 | 5.9 | B | 0.018 |
| SEQ ID NO: 12 | 25 | 1.016 | 7.0 | B | 0.078 |
| SEQ ID NO: 12 | 50 | 1.340 | 9.2 | A | 0.280 |

[1]Percentage solubilised xylose was calculated as described in example 3.
[2]ABC: Least squared values within a column not sharing a capital letter differ significantly (P < 0.05 all pairs Tukey-Kramer HSD).

TABLE 5

Xylose release from DFDSM using GH5 xylanase SEQ ID NO: 18

Table 5 shows the amount of xylose measured after acid hydrolysis of supernatants (% of dry matter and % solubilized xylose of total xylose) when incubating defatted de-starched maize (DFDSM) with the GH5 xylanase of SEQ ID NO: 18 compared to blank and the commercial GH11 xylanase Ronoxyme WX.

| GH5 Xylanase | Conc. [mg EP/kg] | Soluble xylose (%) | % solubilised xylose[1] | Significance[2] | Std. Dev. |
|---|---|---|---|---|---|
| Blank | 0 | 0.001 | 0.0004 | C | 0.001 |
| Ronoxyme WX (GH11) | 25 | 0.053 | 0.04 | C | 0.009 |
| SEQ ID NO: 18 | 10 | 0.934 | 6.4 | B | 0.154 |

[1]Percentage solubilised xylose was calculated as described in example 3.
[2]ABC: Least squared values within a column not sharing a capital letter differ significantly (P < 0.05 all pairs Tukey-Kramer HSD).

TABLE 6

Xylose release from DFDSM using GH5 xylanases SEQ ID NO: 30 and SEQ ID NO: 36

Table 6 shows the amount of xylose measured after acid hydrolysis of supernatants (% of dry matter of and % solubilized xylose of total xylose) when incubating defatted de-starched maize (DFDSM) with the xylanases SEQ ID NO: 30 and SEQ ID NO: 36 compared to blank and the commercial GH11 xylanase Ronoxyme WX.

| GH5 Xylanase | Conc. [mg EP/kg] | Soluble xylose (%) | % solubilised xylose[1] | Significance[2] | Std. Dev. |
|---|---|---|---|---|---|
| Blank | 0 | −0.016 | 0.000 | C | 0.002 |
| Ronozyme WX (GH11) | 25 | 0.060 | 0.408 | C | 0.002 |
| SEQ ID NO: 30 | 10 | 1.261 | 8.514 | A | 0.283 |
| SEQ ID NO: 36 | 10 | 0.445 | 3.004 | B | 0.108 |

[1]Percentage solubilised xylose was calculated as described in example 3.
[2]ABC: Least squared values within a column not sharing a capital letter differ significantly ($P < 0.05$ all pairs Tukey-Kramer HSD).

TABLE 7

Xylose release from DFDSM using GH5 xylanases SEQ ID NO: 42 and SEQ ID NO: 48

Table 7 shows the amount of xylose measured after acid hydrolysis of supernatants (% of dry matter and % solubilized xylose of total xylose) when incubating defatted de-starched maise (DFDSM) with the GH5 xylanases SEQ ID NO: 42 and SEQ ID NO: 48 at different enzyme concentrations compared to blank and the commercial GH11 xylanase Ronoxyme WX.

| GH5 Xylanase | Conc. [mg EP/kg] | Soluble xylose (%) | % solubilised xylose[1] | Significance[2] | Std. Dev. |
|---|---|---|---|---|---|
| Blank | 0 | 0.003 | 0.000 | C | 0.007 |
| Ronozyme WX (GH11) | 25 | 0.060 | 0.383 | C | 0.004 |
| SEQ ID NO: 42 | 10 | 1.330 | 8.963 | B | 0.128 |
| SEQ ID NO: 42 | 25 | 1.411 | 9.511 | AB | 0.134 |
| SEQ ID NO: 48 | 10 | 1.313 | 8.845 | B | 0.113 |
| SEQ ID NO: 48 | 25 | 1.561 | 10.521 | A | 0.129 |

[1]Percentage solubilised xylose was calculated as described in example 3.
[2]ABC: Least squared values within a column not sharing a capital letter differ significantly ($P < 0.05$ all pairs Tukey-Kramer HSD).

As can be seen from tables 3, 4, 5, 6 and 7, the GH5 xylanases comprising motif I, II and/or III are significantly better at releasing xylose from defatted de-starched maize than either blank of the commercial GH11 xylanase Ronoxyme WX.

Example 5: Determination of Hydrolysis of Arabinoxylans in Corn DDGS

Substrate

DDGS from a European corn-based fuel ethanol plant was used as substrate. The DDGS was ground in a coffee blender for 3-4 minutes and washed extensively in water (five times, each wash followed by centrifugation) to remove soluble dry matter.

After the repeated washings a 15% slurry in water was prepared for the trial and adjusted to pH 5.5.

Enzymes

The GH5 xylanases used were SEQ ID NO: 12 and SEQ ID NO: 30.

Assay 4 g slurry was transferred to a PCR-tube plate. Sodium azide (0.05%) and enzyme (30 µg/g dry substrate (DS)) was added each well. The plate was covered with a manual plate-sealer and the samples were incubated for 24 hours at 40° C. and 500 rpm, with samples taken at 0, 4 and 24 hours. The enzymes were deactivated by boiling for 10 minutes.

Analytical Methods

1. Brix Measurements

The soluble dry substance (Brix) was measured after the sample was filtered (0.2 µm filter) using a Mettler Toledo Brix meter and are presented in table 8.

2. Absorption at 320 nm

Adsorption at 320 nm was measured after filtration (0.2 µm filter) followed by 50× dilution. Adsorption at 320 nm is a measure of the soluble fragments containing ferulic acid. The assay was calibrated with a ferulic acid standard (A320 (OD)=0.0147+0.0628*[concentration of ferulic acid in µg/ml]). The results are presented in table 9.

3. Xylose (for 24 Hour Samples)

Xylose content was determined using the "D-xylose assay kit" from Megazymes and are presented in table 10.

Results

TABLE 8

Soluble dry matter as determined using the Brix measurement

| | | Brix measurement | | |
|---|---|---|---|---|
| Enzyme | Enzyme dose | 0 hours (% DS) | 4.5 hours (% DS) | 24 hours (% DS) |
| Blank | | 0.57 | 0.64 | 0.92 |
| SEQ ID NO: 12 | 30 µg/g DS | 0.57 | 1.40 | 1.96 |
| SEQ ID NO: 30 | 30 µg/g DS | 0.57 | 1.54 | 1.89 |
| Blank | | 0.57 | 0.64 | 0.99 |

TABLE 9

Amount of soluble fragments containing ferulic acid measured by adsorption at 320 nm

| | | Release of ferulic acid (mg/ml) | | |
|---|---|---|---|---|
| Enzyme | Enzyme dose | 0 hours | 4.5 hours | 24 hours |
| Blank | | 0.11 | 0.18 | 0.41 |
| SEQ ID NO: 12 | 30 µg/g DS | 0.11 | 0.50 | 0.76 |
| SEQ ID NO: 30 | 30 µg/g DS | 0.11 | 0.63 | 0.85 |
| Blank | | 0.11 | 0.22 | 0.51 |

TABLE 10

Xylose release from DDGS

| | | Release of Xylose (mg/ml) | |
|---|---|---|---|
| Enzyme | Enzyme dose | 0 hours | 24 hours |
| Blank | | 0.19 | 0.22 |
| SEQ ID NO: 12 | 30 µg/g DS | 0.19 | 3.94 |
| SEQ ID NO: 30 | 30 µg/g DS | 0.19 | 3.50 |
| Blank | | 0.19 | 0.26 |

It is concluded from the data in this example that the GH5 enzymes solubilizes about 3.5 mg/ml xylose. If we assume that the xylose constitutes about 60% of the arabinoxylan this amounts then to a solubilization of 5.8 mg/ml arabinoxylan. The total dry matter in the slurry is 150 mg/ml and assuming an arabinoxylan content of 15% in the DDGS (a typical value) we can solubilize 25% of the arabinoxylan in the corn DDGS.

Example 6: Hydrolysis of Defatted Destarched Maize (DFDSM) Using a Commercial Animal Feed Xylanase The experiment was performed as described in example 4 using 3 different commercial xylanases (Rovabio Excel AP, Econase XT 25 or Belfeed B 1100 MP) and the results are presented in table 11.

TABLE 11

Xylose release from DFDSM using Rovabio Excel, Econase XT 25 or Belfeed B 1100 MP Table 11 shows the amount of xylose measured after acid hydrolysis of supernatants (% of dry matter and % solubilized xylose of total xylose) when incubating DFDSM with Rovabio Excel AP, Econase XT 25 or Belfeed B 1100 MP using the commercially recommended doses. Rovabio Excel AP is available from Adisseo and the product declaration states that it has xylanase activity and endo-1,3(4)-beta-glucanase activity. Econase XT 25 is available from AB enzymes and the product declaration states that it has endo-1,4-beta-xylanase activity. Belfeed B 1100 MP is available from Beldem and the product declaration states that it has specific pentosanase endo-1,4-beta xylanase (EC 3.2.1.8) activity.

| Xylanase | Conc. [ppm] | Soluble xylose (%) | Percent solubilised xylose[1] |
|---|---|---|---|
| Rovabio Excel AP | 50 ppm | 0.01 | 0.1 |
| Econase XT 25 | 150 ppm | 0.04 | 0.1 |
| Belfeed B 1100 MP | 100 ppm | 0.04 | 0.2 |

[1]Percentage solubilised xylose was calculated as described in example 3.

Conclusion

The results show that none of the 3 commercial animal feed xylanases tested were able to solubilise significant (>0.5%) amounts of xylose from DFDSM, and therefore are unable to solubilise the highly branched xylan backbone found in maize.

Example 7: Hydrolysis of Defatted Destarched Maize (DFDSM) with GH10 Xylanases or GH11 Xylanases The experiment was performed as described in example 4 using 3 different GH10 xylanases (SEQ ID NO: 49, 50 or 58) or 5 different GH11 xylanase (SEQ ID NO: 51, 52, 53, 54 or 55), and the results are presented in tables 12 and 13 respectively.

SEQ ID NO: 49 corresponds to SEQ ID NO: 5 in WO 1994/021785 (Xyl II, *Aspergillus aculeatus*). SEQ ID NO: 50 corresponds to SEQ ID NO: 8 in WO 2005/059084 (*Aspergillus aculeatus*). SEQ ID NO: 51 corresponds to SEQ ID NO: 2 of WO1996/23062 (*Thermomyces lanuginosus*). SEQ ID NO: 52 corresponds to SEQ ID NO: 305 of WO2011/057140 (*Dictyoglomus thermophilum*). SEQ ID NO: 53 corresponds to SEQ ID NO: 2 of WO2005/079585 (*Paenibacillus pabuli*). SEQ ID NO: 54 corresponds to SEQ ID NO: 8 in WO2014/019220 (*Fusarium oxysporum*, FoxXyn 6). SEQ ID NO: 55 corresponds to SEQ ID NO: 8 in WO2014/020143 (*Aspergillus clavatus*, AclXyn5). SEQ ID NO: 58 corresponds to SEQ ID NO: 1 in WO 2013/068550 (*Thermotoga maritima* MSB8, XynB).

TABLE 12

Xylose release from DFDSM using a GH10 xylanase (SEQ ID NO: 49, 50 or 58)

Table 12 shows the amount of xylose measured after acid hydrolysis of supernatants (% of dry matter and % solubilized xylose of total xylose) when incubating DFDSM with a GH10 xylanase (SEQ ID NO: 49, 50 or 58).

| GH10 Xylanase | Conc. [mg EP/kg] | Soluble xylose (%) | Percent solubilised xylose[1] |
|---|---|---|---|
| SEQ ID NO: 49 | 10 | 0.15 | 0.8 |
| SEQ ID NO: 50 | 10 | 0.26 | 1.9 |
| SEQ ID NO: 58 | 10 | 0.09 | 0.5 |

[1]Percentage solubilised xylose was calculated as described in example 3.

TABLE 13

Xylose release from DFDSM using a GH11 xylanase (SEQ ID NO: 51, 52, 53, 54 or 55)

Table 13 shows the amount of xylose measured after acid hydrolysis of supernatants (% of dry matter and % solubilized xylose of total xylose) when incubating DFDSM with a GH11 xylanase (SEQ ID NO: 51, 52, 53, 54 or 55).

| GH11 Xylanase | Conc. [mg EP/kg] | Soluble xylose (%) | Percent solubilised xylose[1] |
|---|---|---|---|
| SEQ ID NO: 51 | 25 | 0.07 | 0.3 |
| SEQ ID NO: 51 | 25 | 0.09 | 0.5 |
| SEQ ID NO: 52 | 25 | 0.17 | 1.2 |
| SEQ ID NO: 53 | 25 | 0.21 | 1.3 |
| SEQ ID NO: 53 | 25 | 0.16 | 0.9 |
| SEQ ID NO: 54 | 10 | 0.09 | 0.5 |
| SEQ ID NO: 55 | 10 | 0.07 | 0.5 |

[1]Percentage solubilised xylose was calculated as described in example 3.

Conclusion

The results show that none of the known, prior art GH10 or GH11 xylanases were able to solubilise significant (>2.0%) amounts of xylose from DFDSM, and therefore are unable to solubilise the highly branched xylan backbone found in maize.

Example 8: Hydrolysis of Defatted Destarched Maize (DFDSM) Using a Combination of a GH10 or 11 Xylanase and GH43 and/or GH51 Arabinofuranosidases The experiment was performed as described in example 4 and the results are presented in tables 14, 15 and 16.

TABLE 14

Xylose release from DFDSM using a GH10 or 11 xylanase or a GH43 or GH51 arabinofuranosidase Table 14 shows the amount of xylose measured after acid hydrolysis of supernatants (% of dry matter and % solubilized xylose of total xylose) when incubating DFDSM with either a xylanase (Ronozyme WX, a GH11 xylanase from *Thermomyces lanuginosus* or the GH10 xylanase of SEQ ID NO: 49), the GH43 arabinofuranosidase from *Humicola insolens* as disclosed as SEQ ID NO: 1 in WO2006/114095 (SEQ ID NO: 56 herein) or the GH51 arabinofuranosidase from *Meripilus giganteus* as disclosed as SEQ ID NO: 2 in WO2003/114095 (SEQ ID NO: 57 herein).

| GH10 or GH11 Xylanase | Conc. [mg EP/kg] | Arabino-furanosidase | Conc. [mg EP/kg] | Soluble xylose (%) | Percent solubilised xylose[1] |
|---|---|---|---|---|---|
| None | — | None | — | 0 | 0 |
| Ronozyme WX | 200 ppm | None | — | 0.04 | 0.1 |
| SEQ ID NO: 49 | 10 | None | — | 0.13 | 0.7 |

TABLE 14-continued

Xylose release from DFDSM using a GH10 or 11 xylanase or a GH43 or GH51 arabinofuranosidase Table 14 shows the amount of xylose measured after acid hydrolysis of supernatants (% of dry matter and % solubilized xylose of total xylose) when incubating DFDSM with either a xylanase (Ronozyme WX, a GH11 xylanase from *Thermomyces lanuginosus* or the GH10 xylanase of SEQ ID NO: 49), the GH43 arabinofuranosidase from *Humicola insolens* as disclosed as SEQ ID NO: 1 in WO2006/114095 (SEQ ID NO: 56 herein) or the GH51 arabinofuranosidase from *Meripilus giganteus* as disclosed as SEQ ID NO: 2 in WO2003/114095 (SEQ ID NO: 57 herein).

| GH10 or GH11 Xylanase | Conc. [mg EP/kg] | Arabino-furanosidase | Conc. [mg EP/kg] | Soluble xylose (%) | Percent solubilised xylose[1] |
|---|---|---|---|---|---|
| None | — | SEQ ID NO: 56 | 10 | 0.03 | 0.0 |
| None | — | SEQ ID NO: 57 | 10 | 0.02 | 0.0 |

[1]Percentage solubilised xylose was calculated as described in example 3.

TABLE 15

Xylose release from DFDSM using a GH10 xylanase and a GH43 or GH51 arabinofuranosidase Table 15 shows the amount of xylose measured after acid hydrolysis of supernatants (% of dry matter and % solubilized xylose of total xylose) when incubating DFDSM with the GH10 xylanase of SEQ ID NO: 49 alone or in combination with the GH43 arabinofuranosidase from *Humicola insolens* as disclosed as SEQ ID NO: 1 in WO2006/114095 (SEQ ID NO: 56 herein), the GH51 arabinofuranosidase from *Meripilus giganteus* as disclosed as SEQ ID NO: 2 in WO2006/114095 (SEQ ID NO: 57 herein) or both the GH43 and GH51 arabinofuranosidases.

| GH10 Xylanase | Conc. [mg EP/kg] | Arabinofuranosidase | Conc. [mg EP/kg] | Soluble xylose (%) | Percent solubilised xylose[1] |
|---|---|---|---|---|---|
| None | — | None | — | 0 | 0 |
| SEQ ID NO: 49 | 10 | None | — | 0.15 | 0.8 |
| SEQ ID NO: 49 | 10 | SEQ ID NO: 56 | — | 0.18 | 1.1 |
| SEQ ID NO: 49 | 10 | SEQ ID NO: 57 | 10 | 0.18 | 1.1 |
| SEQ ID NO: 49 | 10 | SEQ ID NO: 56 + SEQ ID NO: 57 | 10 + 10 | 0.21 | 1.3 |

[1]Percentage solubilised xylose was calculated as described in example 3.

TABLE 16

Xylose release from DFDSM using a GH11 xylanase and a GH43 or GH51 arabinofuranosidase Table 16 shows the amount of xylose measured after acid hydrolysis of supernatants (% of dry matter and % solubilized xylose of total xylose) when incubating DFDSM with Ronozyme WX (a GH11 xylanase from *Thermomyces lanuginosus*) alone or in combination with the GH43 arabinofuranosidase from *Humicola insolens* as disclosed as SEQ ID NO: 1 in WO2006/114095 (SEQ ID NO: 56 herein), the GH51 arabinofuranosidase from *Meripilus giganteus* as disclosed as SEQ ID NO: 2 in WO2006/114095 (SEQ ID NO: 57 herein) or both the GH43 and GH51 arabinofuranosidases.

| GH11 Xylanase | Conc. [mg EP/kg] | Arabino-furanosidase | Conc. [mg EP/kg] | Soluble xylose (%) | Percent solubilised xylose[1] |
|---|---|---|---|---|---|
| None | — | None | — | 0 | 0.0 |
| Ronozyme WX | 200 ppm | None | — | 0.03 | 0.1 |
| Ronozyme WX | 200 ppm | SEQ ID NO: 56 | — | 0.03 | 0.1 |
| Ronozyme WX | 200 ppm | SEQ ID NO: 57 | 10 | 0.04 | 0.2 |
| Ronozyme WX | 200 ppm | SEQ ID NO: 56 + SEQ ID NO: 57 | 10 + 10 | 0.05 | 0.3 |

[1]Percentage solubilised xylose was calculated as described in example 3.

Conclusion

The results show that neither the GH10 nor GH11 xylanase alone or in combination with either one or both of the prior art GH43 arabinofuranosidases (which has activity towards di-substituted xyloses) or the prior art GH51 arabinofuranosidases (which has activity towards C2- or C3-position mono-substituted xyloses) releases more than 2% solubilised xylose.

Example 9: Hydrolysis of Defatted Destarched Maize (DFDSM) with GH5 Xylanases The experiment was performed as described in example 4 and the results are presented in tables 17 and 18.

TABLE 17

Xylose release from DFDSM using GH5 xylanase SEQ ID NO: 70, 76, 82, 88, 94, 100, 106, 112, 118 or 124

Table 17 shows the amount of xylose measured after acid hydrolysis of supernatants (% of dry matter and % solubilized xylose of total xylose) when incubating defatted de-starched maize (DFDSM) with the GH5 xylanase of SEQ ID NO: 70, 76, 82, 88, 94, 100, 106, 112, 118 or 124.

| GH5 Xylanase | Conc. [mg EP/kg] | Soluble xylose (%) | % solubilised xylose[1] | Significance[2] | Std. Dev. |
|---|---|---|---|---|---|
| Blank | — | 0.016 | 0.0 | F | 0.004 |
| SEQ ID NO: 88 | 10 | 0.624 | 4.1 | E | 0.047 |
| SEQ ID NO: 94 | 10 | 1.194 | 8.0 | C | 0.131 |
| SEQ ID NO: 100 | 10 | 1.188 | 7.9 | C | 0.123 |
| SEQ ID NO: 106 | 10 | 1.264 | 8.4 | BC | 0.082 |
| SEQ ID NO: 112 | 10 | 1.320 | 8.8 | ABC | 0.008 |
| Blank | — | 0.016 | 0.0 | F | 0.002 |
| SEQ ID NO: 118 | 10 | 0.693 | 4.6 | E | 0.097 |
| SEQ ID NO: 70 | 10 | 0.910 | 6.0 | D | 0.079 |
| SEQ ID NO: 82 | 10 | 1.462 | 9.8 | A | 0.061 |
| SEQ ID NO: 124 | 10 | 1.402 | 9.4 | AB | 0.140 |
| SEQ ID NO: 76 | 10 | 1.403 | 9.4 | AB | 0.043 |

[1]Percentage solubilised xylose was calculated as described in example 3.
[2]ABC: Least squared values within a column not sharing a capital letter differ significantly (P < 0.05 all pairs Tukey-Kramer HSD).

TABLE 18

Xylose release from DFDSM using GH5 xylanase SEQ ID NO: 76, 82 or 130

Table 18 shows the amount of xylose measured after acid hydrolysis of supernatants (% of dry matter and % solubilized xylose of total xylose) when incubating defatted de-starched maize (DFDSM) with the GH5 xylanase of SEQ ID NO: 76, 82 or 130.

| GH5 Xylanase | Conc. [mg EP/kg] | Soluble xylose (%) | % solubilised xylose[1] | Significance[2] | Std. Dev. |
|---|---|---|---|---|---|
| Blank | — | 0.033 | 0 | C | 0.003 |
| SEQ ID NO: 130 | 10 | 1.363 | 9 | A | 0.083 |
| SEQ ID NO: 82 | 10 | 1.319 | 8.7 | A | 0.027 |
| SEQ ID NO: 76 | 10 | 1.245 | 8.2 | A | 0.123 |
| SEQ ID NO: 76 | 10 | 1.231 | 8.1 | A | 0.054 |

As can be seen from tables 17 and 18, all of the GH5 xylanases tested (so SEQ ID NO: 70, 76, 82, 88, 94, 100, 106, 112, 118, 124 and 130) comprising motif I, II and/or III are significantly better at releasing xylose from defatted de-starched maize compared to the blank sample.

Example 10: Hydrolysis of *Sorghum* with GH5 Xylanases

Solubilisation of de-starched *sorghum* was assayed in duplicates at a final DM of 10% in the presence of 20 mg EP/kg substrate. The assays were run at 40° C. and pH 5.5 for 4 hrs on a thermomixer and the enzymes were denatured by heating to 95° C. for 10 min. The supernatant was collected after centrifugation and filtered through a 0.22 μm filter. Filtered supernatant was mixed 1:1 with 4 M TFA (trifluoroacetic acid) and hydrolysed at 95 C for 1 hr. The hydrolysate was neutralised with sodium hydroxide and diluted with water before monosaccharides were quantified by High-Performance Anion Exchange Chromatography with Pulsed Amperometric Detection (HPAEC-PAD) using a CarboPac PA1 column (Dionex, Sunnyvale Calif.).

TABLE 19

Solubilisation of de-starched sorghum by xylanases

| Xylanase | Conc. [mg EP/kg] | Soluble xylose (%) | Std. Dev. |
|---|---|---|---|
| Blank | 0 | 0.0082 | 0 |
| SEQ ID NO: 51 (GH11 xylanase) | 20 | 0.038 | 0.002 |
| SEQ ID NO: 49 (GH10 xylanase) | 20 | 0.026 | 0.003 |
| SEQ ID NO: 12 (GH5 xylanase) | 20 | 0.24 | 0.02 |
| SEQ ID NO: 6 (GH5 xylanase) | 20 | 0.22 | 0.02 |
| SEQ ID NO: 42 (GH5 xylanase) | 20 | 0.36 | 0.02 |
| SEQ ID NO: 48 (GH5 xylanase) | 20 | 0.15 | 0.02 |
| SEQ ID NO: 30 (GH5 xylanase) | 20 | 0.43 | 0.01 |

Soluble xylose is measured as released xylose after acid hydrolysis compared to the initial dry mater of de-starched *sorghum*.

As can be seen from table 19, all of the GH5 xylanases tested (so SEQ ID NO: 6, 12, 30, 42 and 48), which comprising motif I, II and/or III, are significantly better at releasing xylose from de-starched *sorghum* compared to blank, a GH10 xylanase or a GH11 xylanase.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

SEQUENCE LISTING (130 sequences)

SEQ ID NO: 1 - DNA, 1695 bp, Paenibacillus illinoisensis
  CDS (1)..(1692)
  sig_peptide (1)..(81)
  mat_peptide (82)..(1692)
atgtggatgtcttgtaaacttttactcgttttggctttactgattacgattgctccatggggaggaagccgcgctgaggcgtgggttggcatgcctatgggcaagcttcacgtaagtggcaagaatctggtgaacagcaacaatcagcctgtgcttctgaacggttggcatcaaccttcaggtgcctactggacgtatcagagcagcaattattatcttaatctgcacggcaacaatcgtcatgcggctacactggcctacctgaaagacattaccgatacatttgcggacacaagtccgaaatatggcagcaatcatggatggaacatgaatcaggtacgtctgttcattgatcgcgaggacatgggtgatgtggcggcgggtacatacaattttgccggtgtgcagaccgttacgcagaacgtcattatcccatacattcaatatgccaaaaccaaaggtgtgtatgtcgtcctgggactcgactttacattgaaggatgaccaggcaaccaccgcttccaacctgcagaaattcaatcaaatctggggatatcttgcatctcgtcccgagattaaaagtgccgataatgttcactttgagctcattaacgagccagtgaaatcgtatgcgaatggacattggggcggatacaacggggaaaatgattttgtggatcactggaatgacctgcgcaatttccagaactccatcatctccacgattcgtagccagggtgccgataacgtcatctgggctgcaggtctggggtataaccagttctacagtctgacggcaagccatccattgacggatcccctgaacaactacggatatgcggttcactggtatccgggttacggcgcgtatgataacttctccattttgcaagatcagtggaataccaatgtgaaagcagctgcagacaagtatccgatcaatatcacggaagtaacctggtttaagaataaacctggtgattcggcttattggaacctgtttaatggcagcaacgaaggttttggtaccaataccaaaaccatcttcaacgcggctggaaacgttagtattgcggctcacatgaacggcttcattcttgagccagggcagcgcagttcttttgccgatccaacggctggactgaaatgggatggcgatgcttcacgaagtgccatgggacggttcctgttcaactggtaccatgaacgtgctcaatcgtacccgggtggaaatggtggtggacccacaaccgggctagtgtcaggtgcaacctacaaaattgtggccagacattccaataaggtcattgacgttcctggggggcaaaatcaaaacaatcttcagcttcagcaatggagcgatctgggtggcaatcctcagaagtgggttctgacctccatcggaggtggcagctatacactaaccagcgtgaactcaccggacaaagttattgatattcgcaacggtactctcacgaacggtgaagcggttcaactcatgagcaatctgaacacgaccgcacagcatttcaaagtcaacgatctggggaatggatactggagtatcattaacgtaaacagcaacaaagcaattgaagtagaaaacgcttccacatctgatggtgccaaactgcagcagaatacgtacacgggtgcaacgaatcaacaatggaaatttatcgcggttagcaattaa

SEQ ID NO: 2 - protein, 564 aa, Paenibacillus illinoisensis
MWMSCKLLLVLALLITIAPWGGSRAEAWVGMPMGKLHVSGKNLVNSNNQPVLLNGWHQPSGAYWTYQSSNYYLNLHGNNRHAATLAYLKDITDTFADTSPKYGSNHGWNMNQVRLFIDREDMGDVAAGTYNFAGVQTVTQNVIIPYIQYAKTKGVYVVLGLDFTLKDDQATTASNLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILEPGQRSSFADPTAGLKWDGDASRSAMGRFLFNWYHERAQSYPGGNGGGPTTGLVSGATYKIVARHSNKVIDVPGGQNQNNLQLQQWSDLGGNPQKWVLTSIGGGSYTLTSVNSPDKVIDIRNGTLTNGEAVQLMSNLNTTAQHFKVNDLGNGYWSIINVNSNKAIEVENASTSDGAKLQQNTYTGATNQQWKFIAVSN

SEQ ID NO: 3 - protein, 537 aa, Paenibacillus illinoisensis
  mat_peptide (1)..(537)
WVGMPMGKLHVSGKNLVNSNNQPVLLNGWHQPSGAYWTYQSSNYYLNLHGNNRHAATLAYLKDITDTFADTSPKYGSNHGWNMNQVRLFIDREDMGDVAAGTYNFAGVQTVTQNVIIPYIQYAKTKGVYVVLGLDFTLKDDQATTASNLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILEPGQRSSFADPTAGLKWDGDASRSAMGRFLFNWYHERAQSYPGGNGGGPTTGLVSGATYKIVARHSNKVIDVPGGQNQNNLQLQQWSDLGGNPQKWVLTSIGGGSYTLTSVNSPDKVIDIRNGTLTNGEAVQLMSNLNTTAQHFKVNDLGNGYWSIINVNSNKAIEVENASTSDGAKLQQNTYTGATNQQWKFIAVSN

SEQ ID NO: 4 - DNA, 1722 bp, Artificial sequence
  Synthetic construct
  CDS (1)..(1719)
  sig_peptide (1)..(81)
  mat_peptide (82)..(1719)
atgaagaaaccgttggggaaaattgtcgcaagcaccgcactactcatttctgttgcttttagttcatcgatcgcatcggctcatcagcaccaacaccagcatcctaggtgggttggcatgccgatgggcaaactgcatgtttcaggcaaaaatctggtcaatagcaataatcaaccggttctgctgaatggctggcatcaaccgtcaggcgcatattggacatatcaatcatcaaactattatctgaatctgcatggaaataatcgccatgcggcaacactggcatatctgaaagatatcacagatacatttgcagacacgtcaccgaaatatggctcaaatcatggctggaatatgaatcaggtccgcctgtttattgatcgcgaagatatgggagatgttgcagcaggcacatataactttgcaggcgttcaaacagttacacagaatgtcattattccgtatatccagtatgcgaaaacgaaaggcgtttatgttgttctgggcctggattttacactgaaagatgatcaagcaacaacagcgagcaatctgcagaaatttaaccaaatttggggctatctggcatcaagaccggaaatcaaatcagcagataacgtccattttgaactgattaacgaaccggttaaaagctatgcaaatggccattggggaggctataatggcgaaaatgattttgtcgatcattggaatgatctgcgcaattttcagaacagcattatttcaacaattcgctcacaaggcgcagataatgttatttgggcagcaggcctgggctataatcagttttattcactgacagcatcacatccgctgacagatccgctgaataactatggctatgcagttcattggtatccgggatatggcgcatatgataactttagcattctgcaggatcagtggaacacaaatgttaaagcagcagcagataaatatccgattaacatcacggaagtcacatggtttaaaaacaaacctggcgattcagcatactggaatctttttaatggcagcaatgaaggctttggcacaaacacaaaaacgatctttaatgcagcaggcaatgttagcattgcagcacatatgaatggctttattctggaaccgggacaaagatcatcatttgcagatccgacagcaggcctgaaatgggatggcgacgcatcaagatcagcaatgggcagatttctgtttaattggtatcatgaaagagcgcaatcatatcctggcggaaatggcggaggaccgacaacaggcctggtttcaggcgcaacatacaaaattgttgcacgccatagcaacaaagtcattgatgtccctggcggacaaaatcaaaacaatctgcaactgcaacagtggtcagatctgggaggcaatccgcaaaaatgggttctgacatcaattggcggaggctcatatacactgacatcagttaattcaccggacaaagtgattgatattcgcaatggcacactgacaaatggcgaagcagttcaactgatgtcaaatctgaatacaacagcgcagcattttaaagtcaatgatctgggcaatggctattggagcattattaacgtcaacagcaacaaagcgatcgaagttgaaaatgcatcaacatcagatggcgcaaaactgcagcaaaatacatatacaggcgcaacaaatcagcagtggaaatttatcgcagtcagcaattaa

SEQ ID NO: 5 - protein, 573 aa, Artificial sequence
  Synthetic Construct
MKKPLGKIVASTALLISVAFSSSIASAHQHQHQHPRWVGMPMGKLHVSGKNLVNSNNQPVLLNGWHQPSGAYWTYQSSNYYLNLHGNNRHAATLAYLKDITDTFADTSPKYGSNHGWNMNQVRLFIDREDMGDVAAGTYNFAGVQTVTQNVIIPYIQYAKTKGVYVVLGLDFTLKDDQATTASNLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILEPGQRSSFADPTAGLKWDGDASRSAMGRFLFNWYHERAQSYPGGNGGGPTTGLVSGATYKIVARHSNKVIDVPGGQNQNNLQLQQWSDLGGNPQKWVLTSIGGGSYTLTSVNSPDKVIDIRNGTLTNGEAVQLMSNLNTTAQHFKVNDLGNGYWSIINVNSNKAIEVENASTSDGAKLQQNTYTGATNQQWKFIAVSN

SEQ ID NO: 6 - protein, 546 aa, Artificial sequence
  Synthetic construct
  mat_peptide (1)..(546)
HQHQHQHPRWVGMPMGKLHVSGKNLVNSNNQPVLLNGWHQPSGAYWTYQSSNYYLNLHGNNRHAATLAYLKDITDTFADTSPKYGSNHGWNMNQVRLFIDREDMGDVAAGTYNFAGVQTVTQNVIIPYIQYAKTKGVYVVLGLDFTLKDDQATTASNLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILEPGQRSSFADPTAGLKWDGDASRSAMGRFLFNWYHERAQSYPGGNGGGPTTGLVSGATYKIVARHSNKVIDVPGGQNQNNLQLQQWSDLGGNPQKWVLTSIGGGSYTLTSVNSPDKVIDIRNGTLTNGEAVQLMSNLNTTAQHFKVNDLGNGYWSIINVNSNKAIEVENASTSDGAKLQQNTYTGATNQQWKFIAVSN

SEQ ID NO: 7 - DNA, 1758 bp, Paenibacillus species
  CDS (1)..(1755)
  sig_peptide (1)..(114)
  mat_peptide (115)..(1755)
ttgctctgtcatatgatagcgcttacaaaaacgccatttcgaggaggagattcattaatgagaagagtagtgcaatggctgaagctggccacgattgcggcggtgattttggctttgacggttccgcccggcgccccggccgaggcttggtctggcatgcctacgcccaagcttcatgtcagcggcaaccaactggtaaatgcaaacggacagcctgtcctgctaagcgggtggcatcagccttccgggtcctactggacgtatcagagcagcagttactacctggaccgtaacggcggaaaccggcatgccgccaacctggcgtatctcaaggatatcacagacacctttacggacacctcgcccaaatacgggaacaaccacggctggtatatgaatcaggttcggctattcattgatcgcgaggatatgggggatgtcgccgaaggcacttacaactttgctggattgcaggcggttacgcaaaatgtgattattccgtacattaattatgcgagaacaaaagggctttatgtgacgctcggactggattttacgctcaaagacaatcaggcgaccacacaggccaatttggacaagttcaatcagatttggagttatctagcatccagaccggaaataagaagcgctgacaacgtcatgtttgaaattattaacgagccggtattgtcgtatgcggacggcagatggggcggtcatccgtccgaccctcattttatagcattctggaacgatttgcgcagttttcaaaactctatcatctcctccattcgcgcacaaggagcggataatgtgatctgggcggccgggctcggctgggatcagtactaccagttgtgtgcgtcgcatcctctgacggacccgctcaataatgtaggttatgcggttcactggtatccgggatatggagcaggggataactattcggtgcttcagcaacaatgggatacgaatattaagccatgcgccgacaactatccgatcaatataacggaaacgacctggttcaagcgactgcctggcgattcggattactggaatttgttcaatggctcgagcgagggcttcggcaaaaatacgaaagcaatctttactgcggcgggcaatgccagcattgccgtccatatgaacggctttttattggcgccgggagcaagaagctcatttgccgatccgactgccggtctgttatacgacggaaatacagctcgagacggcatggcccgctttatattcgagtggtattacgaaagagcgcagttcttgccgtggaatggcatttggaacggactgttcacaggatcgacctacaagttcgtgaatcgggcaaccggcaaaaatatggatgtgccgggcggacaaaacaataataatctgcaattgaaccaatggacggataatggagcaacggcgcagcgctgggtcgtagacgatatgggcactttcaacaatatatatcgcatgaagagcgtcagctcatcggacggcaaggtaatggatgtccgcaacggcaccaaaaacaatggagaagccattcagcttatgcaggacttctcgaacacggcgcagcgtttccggattattcgacttagcaacggctattggagcattattaatgtcaacagcaacaaagcggttgaggtcgccggcggcgcttctcatgacggagcgctattgcaacagaacatgtatcgcggagatcatcatcaacagtggcagctggttcagattcaataa

SEQ ID NO: 8 - protein, 585 aa, Paenibacillus species
LLCHMIALTKTPFRGGDSLMRRVVQWLKLATIAAVILALTVPPGAPAEAWSGMPTPKLHVSGNQLVNANGQPVLLSGWHQPSGSYWTYQSSSYYLDRNGGNRHAANLAYLKDITDTFTDTSPKYGNNHGWYMNQVRLFIDREDMGDVAEGTYNFAGLQAVTQNVIIPYINYARTKGLYVTLGLDFTLKDNQATTQANLDKFNQIWSYLASRPEIRSADNVMFEIINEPVLSYADGRWGGHPSDPHFIAFWNDLRSFQNSIISSIRAQGADNVIWAAGLGWDQYYQLCASHPLTDPLNNVGYAVHWYPGYGAGDNYSVLQQQWDTNIKPCADNYPINITETTWFKRLPGDSDYWNLFNGSSEGFGKNTKAIFTAAGNASIAVHMNGFLLAPGARSSFADPTAGLLYDGNTARDGMARFIFEWYYERAQFLPWNGIWNGLFTGSTYKFVNRATGKNMDVPGGQNNNNLQLNQWTDNGATAQRWVVDDMGTFNNIYRMKSVSSSDGKVMDVRNGTKNNGEAIQLMQDFSNTAQRFRIIRLSNGYWSIINVNSNKAVEVAGGASHDGALLQQNMYRGDHHQQWQLVQIQ

SEQ ID NO: 9 - protein, 547 aa, Paenibacillus species
  mat_peptide (1)..(547)
LTVPPGAPAEAWSGMPTPKLHVSGNQLVNANGQPVLLSGWHQPSGSYWTYQSSSYYLDRNGGNRHAANLAYLKDITDTFTDTSPKYGNNHGWYMNQVRLFIDREDMGDVAEGTYNFAGLQAVTQNVIIPYINYARTKGLYVTLGLDFTLKDNQATTQANLDKFNQIWSYLASRPEIRSADNVMFEIINEPVLSYADGRWGGHPSDPHFIAFWNDLRSFQNSIISSIRAQGADNVIWAAGLGWDQYYQLCASHPLTDPLNNVGYAVHWYPGYGAGDNYSVLQQQWDTNIKPCADNYPINITETTWFKRLPGDSDYWNLFNGSSEGFGKNTKAIFTAAGNASIAVHMNGFLLAPGARSSFADPTAGLLYDGNTARDGMARFIFEWYYERAQFLPWNGIWNGLFTGSTYKFVNRATGKNMDVPGGQNNNNLQLNQWTDNGATAQRWVVDDMGTFNNIYRMKSVSSSDGKVMDVRNGTKNNGEAIQLMQDFSNTAQRFRIIRLSNGYWSIINVNSNKAVEVAGGASHDGALLQQNMYRGDHHQQWQLVQIQ

SEQ ID NO: 10 - DNA, 1749 bp, Artificial sequence
  Synthetic construct
  CDS (1)..(1746)
  sig_peptide (1)..(81)
  mat_peptide (82)..(1746)
atgaagaaaccgttggggaaaattgtcgcaagcaccgcactactcatttctgttgcttttagttcatcgatagcatcagcacatcatcatcaccatcatcctaggttgacggttccgcccggcgccccggccgaggcttggtctggcatgcctacgcccaagcttcatgtcagcggcaaccaactggtaaatgcaaacggacagcctgtcctgctaagcgggtggcatcagccttccgggtcctactggacgtatcagagcagcagttactacctggaccgtaacggcggaaaccggcatgccgccaacctggcgtatctcaaggatatcacagacacctttacggacacctcgcccaaatacgggaacaaccacggctggtatatgaatcaggttcggctattcattgatcgcgaggatatgggggatgtcgccgaaggcacttacaactttgctggattgcaggcggttacgcaaaatgtgattattccgtacattaattatgcgagaacaaaagggctttatgtgacgctcggactggattttacgctcaaagacaatcaggcgaccacacaggccaatttggacaagttcaatcagatttggagttatctagcatccagaccggaaataagaagcgctgacaacgtcatgtttgaaattattaacgagccggtattgtcgtatgcggacggcagatggggcggtcatccgtccgaccctcattttatagcattctggaacgatttgcgcagttttcaaaactctatcatctcctccattcgcgcacaaggagcggataatgtgatctgggcggccgggctcggctgggatcagtactaccagttgtgtgcgtcgcatcctctgacggacccgctcaataatgtaggttatgcggttcactggtatccgggatatggagcaggggataactattcggtgcttcagcaacaatgggatacgaatattaagccatgcgccgacaactatccgatcaatataacggaaacgacctggttcaagcgactgcctggcgattcggattactggaatttgttcaatggctcgagcgagggcttcggcaaaaatacgaaagcaatctttactgcggcgggcaatgccagcattgccgtccatatgaacggctttttattggcgccgggagcaagaagctcatttgccgatccgactgccggtctgttatacgacggaaatacagctcgagacggcatggcccgctttatattcgagtggtattacgaaagagcgcagttcttgccgtggaatggcatttggaacggactgttcacaggatcgacctacaagttcgtgaatcgggcaaccggcaaaaatatggatgtgccgggcggacaaaacaataataatctgcaattgaaccaatggacggataatggagcaacggcgcagcgctgggtcgtagacgatatgggcactttcaacaatatatatcgcatgaagagcgtcagctcatcggacggcaaggtaatggatgtccgcaacggcaccaaaaacaatggagaagccattcagcttatgcaggacttctcgaacacggcgcagcgtttccggattattcgacttagcaacggctattggagcattattaatgtcaacagcaacaaagcggttgaggtcgccggcggcgcttctcatgacggagcgctattgcaacagaacatgtatcgcggagatcatcatcaacagtggcagctggttcagattcaataa

SEQ ID NO: 11 - protein, 582 aa, Artificial sequence
  Synthetic Construct
MKKPLGKIVASTALLISVAFSSSIASAHHHHHHPRLTVPPGAPAEAWSGMPTPKLHVSGNQLVNANGQPVLLSGWHQPSGSYWTYQSSSYYLDRNGGNRHAANLAYLKDITDTFTDTSPKYGNNHGWYMNQVRLFIDREDMGDVAEGTYNFAGLQAVTQNVIIPYINYARTKGLYVTLGLDFTLKDNQATTQANLDKFNQIWSYLASRPEIRSADNVMFEIINEPVLSYADGRWGGHPSDPHFIAFWNDLRSFQNSIISSIRAQGADNVIWAAGLGWDQYYQLCASHPLTDPLNNVGYAVHWYPGYGAGDNYSVLQQQWDTNIKPCADNYPINITETTWFKRLPGDSDYWNLFNGSSEGFGKNTKAIFTAAGNASIAVHMNGFLLAPGARSSFADPTAGLLYDGNTARDGMARFIFEWYYERAQFLPWNGIWNGLFTGSTYKFVNRATGKNMDVPGGQNNNNLQLNQWTDNGATAQRWVVDDMGTFNNIYRMKSVSSSDGKVMDVRNGTKNNGEAIQLMQDFSNTAQRFRIIRLSNGYWSIINVNSNKAVEVAGGASHDGALLQQNMYRGDHHQQWQLVQIQ

SEQ ID NO: 12 - protein, 555 aa, Artificial sequence
  Synthetic construct
  mat_peptide (1)..(555)
HHHHHHPRLTVPPGAPAEAWSGMPTPKLHVSGNQLVNANGQPVLLSGWHQPSGSYWTYQSSSYYLDRNGGNRHAANLAYLKDITDTFTDTSPKYGNNHGWYMNQVRLFIDREDMGDVAEGTYNFAGLQAVTQNVIIPYINYARTKGLYVTLGLDFTLKDNQATTQANLDKFNQIWSYLASRPEIRSADNVMFEIINEPVLSYADGRWGGHPSDPHFIAFWNDLRSFQNSIISSIRAQGADNVIWAAGLGWDQYYQLCASHPLTDPLNNVGYAVHWYPGYGAGDNYSVLQQQWDTNIKPCADNYPINITETTWFKRLPGDSDYWNLFNGSSEGFGKNTKAIFTAAGNASIAVHMNGFLLAPGARSSFADPTAGLLYDGNTARDGMARFIFEWYYERAQFLPWNGIWNGLFTGSTYKFVNRATGKNMDVPGGQNNNNLQLNQWTDNGATAQRWVVDDMGTFNNIYRMKSVSSSDGKVMDVRNGTKNNGEAIQLMQDFSNTAQRFRIIRLSNGYWSIINVNSNKAVEVAGGASHDGALLQQNMYRGDHHQQWQLVQIQ

SEQ ID NO: 13 - DNA, 1875 bp, Unknown
  Elephant dung metagenome
  CDS (1)..(1872)
  sig_peptide (1)..(78)
  mat_peptide (79)..(1872)
atgataagaaaattacacaaatcatggagactgttccttttggtcttcgttctggttatttccaacgaatcattcgcttggcgtggaatgcgcatgcctgaactattcattaaaggccgttacctcatggctaaggatatgaacggcaatgatagtatcgtaaaccttcatggtttcggacagacatactctgcctatttcaatggatatgcttggtgtaagaaccctgatggctcggtcaactggggtaagactaaggatgctgccgcatgcgtgaaatggaataaggagcagattggacttatgcttgaccatggttggaaggtcaactggcttcgacttcacatggatccagcatggagcaacaacgagacaaaggtcaatcaatggcaaagccagcatccaggcacttactacagcgagaatcttatcgtggcattcgatatgaacctcttcaagaaataccttgacgagatcttcattcctatggcagaatatgccattgagaatggcatctacgtggttatgcgcccacctggtgtatgccctcagaaacttaccgtaggcgatgaatatcagcagtatcttatcaaagtatggacttacgtatgtagccacgagaagcttaagaataacccatacattatgtttgagcttgccaatgaacctatcgacatgaacgatggtaacggcaactacacaagctggtctgacggttctcagaagaactgcacaaagttcttccagaagattgttgacgagatccgtgccgtgggctgcaacaacattctctgggtaccgggacttgcctatcagcagaactatcagggctatgtgaagtatcctattgtaggcgagaacatcggattcgccgtgcattgctacccaggctggtatggctctgactcagaagttgcttcagcagaacagcagattgtgaccaacggcaacacctacgccgacttccagtcaggctggagtgcaagcatcgatggtgtctcaaagcttcgtcctatcattgtcacagagatggactgggctccaaagaaatacaatagctcatggggtaaggctacaacaggcaagctcggtggtgtaggcttcggaaacaacttcaaatacatcatggataagaccggcaacgtgagctggatgctgtttaccgatgcagataagcttgccaaatatgatgactcaaaagctgatggaagcaccttcctcaccgacccagaggcatgcccacgccctgtatatcgctggtataaggaatatgcagaaccaggttggaagttcgttgaaacccttgccgatgagttctatatgttccctggcaccaactctatcttcagccctaacatctgggagaaaggcacactcaccaagaacgatgacggcagtcgcaccctcgtcaccggtcagtatggcttcggcggatggaaattcggtggtggtctcgacatgtccggatacaaatatcttgtgttaaaccttacaaaggcaccagcgtcaaatcaatggtcattaagattgtttgatgtagataactactggacagatccttatatgaaggatgtaaagagcagcacacgcgttgtcgttgacctccagaatatgaagaacagcaagggcgtaaaggttgacccttcacatatctatatcctcggactttggagtactggtggaacgcctatcactattaaggatatctatcttaccaacaactctgactattcaccagagtcaactggtatcagcgagacactcgcagaaaagcgccttgacactcctatctacaacctgagtggacagcgtgtaacagaaccaagaaacggacatgtctatattagaaacggcaagaaatttatttacaaataa

SEQ ID NO: 14 - protein, 624 aa, Unknown
  Synthetic Construct
MIRKLHKSWRLFLLVFVLVISNESFAWRGMRMPELFIKGRYLMAKDMNGNDSIVNLHGFGQTYSAYFNGYAWCKNPDGSVNWGKTKDAAACVKWNKEQIGLMLDHGWKVNWLRLHMDPAWSNNETKVNQWQSQHPGTYYSENLIVAFDMNLFKKYLDEIFIPMAEYAIENGIYVVMRPPGVCPQKLTVGDEYQQYLIKVWTYVCSHEKLKNNPYIMFELANEPIDMNDGNGNYTSWSDGSQKNCTKFFQKIVDEIRAVGCNNILWVPGLAYQQNYQGYVKYPIVGENIGFAVHCYPGWYGSDSEVASAEQQIVTNGNTYADFQSGWSASIDGVSKLRPIIVTEMDWAPKKYNSSWGKATTGKLGGVGFGNNFKYIMDKTGNVSWMLFTDADKLAKYDDSKADGSTFLTDPEACPRPVYRWYKEYAEPGWKFVETLADEFYMFPGTNSIFSPNIWEKGTLTKNDDGSRTLVTGQYGFGGWKFGGGLDMSGYKYLVLNLTKAPASNQWSLRLFDVDNYWTDPYMKDVKSSTRVVVDLQNMKNSKGVKVDPSHIYILGLWSTGGTPITIKDIYLTNNSDYSPESTGISETLAEKRLDTPIYNLSGQRVTEPRNGHVYIRNGKKFIYK

SEQ ID NO: 15 - protein, 598 aa, Unknown
  Elephant dung metagenome
  mat_peptide (1)..(598)
WRGMRMPELFIKGRYLMAKDMNGNDSIVNLHGFGQTYSAYFNGYAWCKNPDGSVNWGKTKDAAACVKWNKEQIGLMLDHGWKVNWLRLHMDPAWSNNETKVNQWQSQHPGTYYSENLIVAFDMNLFKKYLDEIFIPMAEYAIENGIYVVMRPPGVCPQKLTVGDEYQQYLIKVWTYVCSHEKLKNNPYIMFELANEPIDMNDGNGNYTSWSDGSQKNCTKFFQKIVDEIRAVGCNNILWVPGLAYQQNYQGYVKYPIVGENIGFAVHCYPGWYGSDSEVASAEQQIVTNGNTYADFQSGWSASIDGVSKLRPIIVTEMDWAPKKYNSSWGKATTGKLGGVGFGNNFKYIMDKTGNVSWMLFTDADKLAKYDDSKADGSTFLTDPEACPRPVYRWYKEYAEPGWKFVETLADEFYMFPGTNSIFSPNIWEKGTLTKNDDGSRTLVTGQYGFGGWKFGGGLDMSGYKYLVLNLTKAPASNQWSLRLFDVDNYWTDPYMKDVKSSTRVVVDLQNMKNSKGVKVDPSHIYILGLWSTGGTPITIKDIYLTNNSDYSPESTGISETLAEKRLDTPIYNLSGQRVTEPRNGHVYIRNGKKFIYK

SEQ ID NO: 16 - DNA, 1902 bp, Artificial sequence
  Synthetic construct
  CDS (1)..(1899)
  sig_peptide (1)..(81)
  mat_peptide (82)..(1899)
atgaagaaaccgttggggaaaattgtcgcaagcaccgcactactcatttctgttgcttttagttcatcgatagcatcagcacatcatcatcaccatcatcctaggtggcgtggcatgagaatgccggaactgtttatcaaaggcagatatctgatggcgaaagatatgaatggcaacgatagcattgttaatctgcatggctttggccaaacatatagcgcgtattttaacggctatgcgtggtgcaaaaatccggatggctcagttaattggggcaaaacaaaagatgcagcagcatgcgttaaatggaataaagaacaaattggcctgatgctggatcatggctggaaagttaattggctgagactgcatatggatccggcatggtcaaataatgaaacaaaagtcaatcaatggcagagccaacatccgggaacatattattcagaaaatctgatcgtcgcgtttgatatgaacctgtttaaaaaatatctggatgaaatctttattccgatggcggaatatgcgattgaaaacggcatttatgttgttatgcgtccgcctggcgtttgtccgcaaaaactgacagttggagatgaatatcagcagtacctgattaaagtctggacatatgtttgcagccatgaaaaactgaaaaacaatccgtatattatgtttgaactggcgaacgaaccgatcgatatgaatgatggcaatggcaattatacgtcatggtcagatggctcacagaaaaactgcacgaaattttttcagaaaattgtcgacgaaattagagcagtcggctgcaataacattctgtgggttccgggactggcatatcaacaaaattatcaaggctatgtcaaatacccgattgtcggcgaaaatattggctttgcagttcattgctatccgggatggtatggctcagattcagaagttgcatcagcagaacaacaaattgtcacaaacggcaatacgtatgcggattttcaatcaggctggtcagcaagcattgatggcgtttcaaaacttagaccgattatcgtcacagaaatggattgggcaccgaaaaaatacaattcatcatggggcaaagcaacgacaggcaaactgggaggcgttggctttggcaataactttaaatacatcatggacaaaacaggcaacgttagctggatgctgtttacagatgcagataaactggcgaaatatgatgattcaaaagcagatggcagcacgtttctgacagatccggaagcatgccctagaccggtttatagatggtataaagaatatgcagaaccgggatggaaatttgttgaaacactggcagatgaattttacatgtttccgggaacaaacagcatttttagcccgaacatttgggaaaaaggcacactgacaaaaaatgatgatggctcaagaacactggtcacaggccaatatggctttggaggctggaaatttggcggaggcctggatatgtcaggctataaatacctggttctgaacctgacaaaagcaccggcatcaaatcaatggtcactgagactgtttgatgtcgataactattggacagacccgtatatgaaagatgtcaaatcaagcacaagagtcgttgtcgatctgcagaatatgaaaaatagcaaaggcgttaaagtcgacccgagccatatctatattctgggcctgtggtcaacaggcggaacaccgattacaattaaagatatctatctgacaaataatagcgattattcaccggaatcaacaggcatttcagaaacacttgcagaaaaaagactggacacaccgatttataacctgtcaggccaaagagttacagaaccgagaaatggccatgtctatattcgcaacggcaaaaaattcatttacaaataa

SEQ ID NO: 17 - protein, 633 aa, Artificial sequence
  Synthetic Construct
MKKPLGKIVASTALLISVAFSSSIASAHHHHHHPRWRGMRMPELFIKGRYLMAKDMNGNDSIVNLHGFGQTYSAYFNGYAWCKNPDGSVNWGKTKDAAACVKWNKEQIGLMLDHGWKVNWLRLHMDPAWSNNETKVNQWQSQHPGTYYSENLIVAFDMNLFKKYLDEIFIPMAEYAIENGIYVVMRPPGVCPQKLTVGDEYQQYLIKVWTYVCSHEKLKNNPYIMFELANEPIDMNDGNGNYTSWSDGSQKNCTKFFQKIVDEIRAVGCNNILWVPGLAYQQNYQGYVKYPIVGENIGFAVHCYPGWYGSDSEVASAEQQIVTNGNTYADFQSGWSASIDGVSKLRPIIVTEMDWAPKKYNSSWGKATTGKLGGVGFGNNFKYIMDKTGNVSWMLFTDADKLAKYDDSKADGSTFLTDPEACPRPVYRWYKEYAEPGWKFVETLADEFYMFPGTNSIFSPNIWEKGTLTKNDDGSRTLVTGQYGFGGWKFGGGLDMSGYKYLVLNLTKAPASNQWSLRLFDVDNYWTDPYMKDVKSSTRVVVDLQNMKNSKGVKVDPSHIYILGLWSTGGTPITIKDIYLTNNSDYSPESTGISETLAEKRLDTPIYNLSGQRVTEPRNGHVYIRNGKKFIYK

SEQ ID NO: 18 - protein, 606 aa, Artificial sequence
  Synthetic construct
  mat_peptide (1)..(606)
HHHHHHPRWRGMRMPELFIKGRYLMAKDMNGNDSIVNLHGFGQTYSAYFNGYAWCKNPDGSVNWGKTKDAAACVKWNKEQIGLMLDHGWKVNWLRLHMDPAWSNNETKVNQWQSQHPGTYYSENLIVAFDMNLFKKYLDEIFIPMAEYAIENGIYVVMRPPGVCPQKLTVGDEYQQYLIKVWTYVCSHEKLKNNPYIMFELANEPIDMNDGNGNYTSWSDGSQKNCTKFFQKIVDEIRAVGCNNILWVPGLAYQQNYQGYVKYPIVGENIGFAVHCYPGWYGSDSEVASAEQQIVTNGNTYADFQSGWSASIDGVSKLRPIIVTEMDWAPKKYNSSWGKATTGKLGGVGFGNNFKYIMDKTGNVSWMLFTDADKLAKYDDSKADGSTFLTDPEACPRPVYRWYKEYAEPGWKFVETLADEFYMFPGTNSIFSPNIWEKGTLTKNDDGSRTLVTGQYGFGGWKFGGGLDMSGYKYLVLNLTKAPASNQWSLRLFDVDNYWTDPYMKDVKSSTRVVVDLQNMKNSKGVKVDPSHIYILGLWSTGGTPITIKDIYLTNNSDYSPESTGISETLAEKRLDTPIYNLSGQRVTEPRNGHVYIRNGKKFIYK

SEQ ID NO: 19 - protein, 8 aa, Artificial sequence
  Synthetic construct
  MISC_FEATURE (2)..(2): The amino acid in position 2 of the conserved motif is either tyrosine (Try, Y) or phenylalanine (Phe, F).
  MISC_FEATURE (3)..(3): The amino acid in position 3 of the conserved motif is either alanine (Ala, A) or Serine (Ser, S)
  MISC_FEATURE (4)..(4): The amino acid in position 4 of the conserved motif is either valine (Val, V), glycine (Gly, G), isoleucine (Ile, I) or alanine (Ala, A).
  MISC_FEATURE (6)..(6): The amino acid in position 6 is any amino acid.
  MISC_FEATURE (8)..(8): The amino acid in position 8 of the conserved motif is either proline (Pro, P) or Valine (Val, V)
GXXXHXYX

SEQ ID NO: 20 - protein, 9 aa, Artificial sequence
  Synthetic construct
  MISC_FEATURE (1)..(1): The amino acid in position 1 of the conserved motif is either isoleucine (ILe, I), leucine (Leu, L) or valine (Val, V)
  MISC_FEATURE (2)..(2): The amino acid in position 2 of the conserved motif is either histidine (His, H), isoleucine (ILe, I), leucine (Leu, L), methionine (Met, M) or valine (Val, V)
  MISC_FEATURE (3)..(3): The amino acid in position 3 of the conserved motif is either phenylalanine (Phe, F) or tyrosine (Tyr, Y).
  MISC_FEATURE (4)..(4): The amino acid in position 4 of the conserved motif is either aspartic acid (Asp, D) or glutamic acid (Glu, E)
  MISC_FEATURE (5)..(5): The amino acid in position 5 of the conserved motif is either isoleucine (ILe, I), leucine (Leu, L) or valine (Val, V)
  MISC_FEATURE (6)..(6): The amino acid in position 6 of the conserved motif is any natural amino acid.
XXXXXXNEP

SEQ ID NO: 21 - protein, 11 aa, Artificial sequence
  Synthetic construct
  MISC_FEATURE (1)..(1): The amino acid in position 1 of the conserved motif is either aspartic acid (Asp, D) or glycine (Gly, G).
  MISC_FEATURE (2)..(2): The amino acid in position 2 of the conserved motif is either alanine (Ala, A), threonine (thr, T) or Tryptophan (Trp, W).
  MISC_FEATURE (3)..(3): The amino acid in position 3 of the conserved motif is any natural amino acid.
  MISC_FEATURE (4)..(4): The amino acid in position 4 of the conserved motif is any natural amino acid.
  MISC_FEATURE (5)..(5): The amino acid in position 5 of the conserved motif is asparagine (Asn, N) or threonine (Thr, T).
  MISC_FEATURE (6)..(6): The amino acid in position 6 of the conserved motif is any natural amino acid.
  MISC_FEATURE (7)..(7): The amino acid in position 7 of the conserved motif is isoleucine (Ile, I), leucine (leu, L), phenylalanine (Phe, F) or valine (val, V).
  MISC_FEATURE (9)..(9): The amino acid in position 9 of the conserved motif is alanine (Ala, A), leucine (leu, L) or methionine (Met, M).
  MISC_FEATURE (10)..(10): The amino acid in position 10 of the conserved motif is alanine (Ala, A), phenylalanine (Phe, F) or histidine (His, H).
  MISC_FEATURE (11)..(11): The amino acid in position 11 of the conserved motif is isoleucine (Ile, I), leucine (leu, L) or methionine (Met, M).
XXXXXXXRXXX

SEQ ID NO: 22 - protein, 27 aa, Artificial sequence
  Synthetic construct
  sig_peptide (1)..(17)
MKKPLGKIVASTALLISVAFSSSIASA

SEQ ID NO: 23 - protein, 8 aa, Artificial sequence
  Synthetic construct
HHHHHHPR

SEQ ID NO: 24 - protein, 9 aa, Artificial sequence
  Synthetic construct
HQHQHQHPR

SEQ ID NO: 25 - DNA, 1722 bp, Chryseobacterium species
  CDS (1)..(1719)
  sig_peptide (1)..(69)
  mat_peptide (70)..(1719)
atgagaacaaacaaaatgtggctttttctggcctttctgttaatcattctttccagctgttctacgatggatgaaaaaaatttactagaagaccctgactccaacttaagtgccggcgctagcgcaagagcattggcagcaacaccaatgctgcatgtcggaggcagataccttaaagatccgtgtgacaataatgttgtcttacatggtgtcgccataactccaagcccctggttcaatggctgtcagtatggcgccaattccggctactgtacctgggataattacaatgtacagggcgcactgaactataataaggctgtgatgaacaagctcaccagtgctgctgatggctggtatctcaattacatccgccttcatattgatccgtattggaccaatgatcccggaccggctatcccagagaacgatatctcaagattcaattataaccgcctggtaacttacacagatcaggtgataatcccgctgattaaccatgcccgcagcctgggaatgtatgtcatcctacgtccgccaggcgtatgtccaaatcgtattgctgtgaacgatgcctatcatagctatcttaaaaccgtatggacctttttgtcgcaacatccggggctaaagaacgctgacaatgtgatgttcgaattagccaacgaacctgttgagattctgggtacaaatggcacatggggatcgacaggaaacgagcactttgcagcacttaaaaacttcttccagccattagttaacatcattcgcaacaatggagccaataatgtttgctggataccgggtacaggatggcaatcccattaccaaggctatgtcaataaccagattacaggtggtaatattggttatgctgttcatatctatccggcttactggggcggtctcagcaactatcaagcctttcagaatgcatggaatatcaatgttaaaccaatcgcagacattgcaccaattgccattaccgagaccgactgggcaccgcagggttatggtaccttcggtatcggtacaacaggtacggcaggcggaagcggatttggcgccaatttaaaatatatcgtggatcagtcaggcaatgtaagctggaatgttcttgccccggataatctcctccacaaaggcgatcctaatgcaggaacagcctacaacaacgattgggaagcctgcgccgcaccagttaaacagtggttccagcaatatgcatcctccaattatcctgttggaaactgtaatacaaccagcagcctggttaataatggcatttacgaaatcgagtttcagaccgatgccaataaagtagttgatctaaaatccggagaggatgccaatggcgcagtgttaagaccatggacaaggaatggtgctgctgcacagcgctgggttgcaattgacgccggcaatggttactggcgttttgtatccaaagcgagtgcaaccaatcgctgcattgacttagccagtaacagcaatacactgggaacctcgatcaggctttggcagaactatggtaatgatgcacaagcctggcaggtagttgctgtctccaatggttattataaaatcctgtccaaggtggaccctacacgtggctgggatattcccaactgtaccatggatggcaattcaaacttacacctttgggattattatggtacgtcctgtcagttgttcaagttcaaatatattgggatgaactga

SEQ ID NO: 26 - protein, 573 aa, Chryseobacterium species
MRTNKMWLFLAFLLIILSSCSTMDEKNLLEDPDSNLSAGASARALAATPMLHVGGRYLKDPCDNNVVLHGVAITPSPWFNGCQYGANSGYCTWDNYNVQGALNYNKAVMNKLTSAADGWYLNYIRLHIDPYWTNDPGPAIPENDISRFNYNRLVTYTDQVIIPLINHARSLGMYVILRPPGVCPNRIAVNDAYHSYLKTVWTFLSQHPGLKNADNVMFELANEPVEILGTNGTWGSTGNEHFAALKNFFQPLVNIIRNNGANNVCWIPGTGWQSHYQGYVNNQITGGNIGYAVHIYPAYWGGLSNYQAFQNAWNINVKPIADIAPIAITETDWAPQGYGTFGIGTTGTAGGSGFGANLKYIVDQSGNVSWNVLAPDNLLHKGDPNAGTAYNNDWEACAAPVKQWFQQYASSNYPVGNCNTTSSLVNNGIYEIEFQTDANKVVDLKSGEDANGAVLRPWTRNGAAAQRWVAIDAGNGYWRFVSKASATNRCIDLASNSNTLGTSIRLWQNYGNDAQAWQVVAVSNGYYKILSKVDPTRGWDIPNCTMDGNSNLHLWDYYGTSCQLFKFKYIGMN

SEQ ID NO: 27 - protein, 550 aa, Chryseobacterium species
  mat_peptide (1)..(550)
DEKNLLEDPDSNLSAGASARALAATPMLHVGGRYLKDPCDNNVVLHGVAITPSPWFNGCQYGANSGYCTWDNYNVQGALNYNKAVMNKLTSAADGWYLNYIRLHIDPYWTNDPGPAIPENDISRFNYNRLVTYTDQVIIPLINHARSLGMYVILRPPGVCPNRIAVNDAYHSYLKTVWTFLSQHPGLKNADNVMFELANEPVEILGTNGTWGSTGNEHFAALKNFFQPLVNIIRNNGANNVCWIPGTGWQSHYQGYVNNQITGGNIGYAVHIYPAYWGGLSNYQAFQNAWNINVKPIADIAPIAITETDWAPQGYGTFGIGTTGTAGGSGFGANLKYIVDQSGNVSWNVLAPDNLLHKGDPNAGTAYNNDWEACAAPVKQWFQQYASSNYPVGNCNTTSSLVNNGIYEIEFQTDANKVVDLKSGEDANGAVLRPWTRNGAAAQRWVAIDAGNGYWRFVSKASATNRCIDLASNSNTLGTSIRLWQNYGNDAQAWQVVAVSNGYYKILSKVDPTRGWDIPNCTMDGNSNLHLWDYYGTSCQLFKFKYIGMN

SEQ ID NO: 28 - DNA, 1758 bp, Artificial sequence
  Synthetic construct
  CDS (1)..(1755)
  sig_peptide (1)..(81)
  mat_peptide (82)..(1755)
atgaagaaaccgttggggaaaattgtcgcaagcaccgcactactcatttctgttgcttttagttcatcgatagcatcagcacatcatcatcaccatcatcctagggatgaaaaaaatttactagaagaccctgactccaacttaagtgccggcgctagcgcaagagcattggcagcaacaccaatgctgcatgtcggaggcagataccttaaagatccgtgtgacaataatgttgtcttacatggtgtcgccataactccaagcccctggttcaatggctgtcagtatggcgccaattccggctactgtacctgggataattacaatgtacagggcgcactgaactataataaggctgtgatgaacaagctcaccagtgctgctgatggctggtatctcaattacatccgccttcatattgatccgtattggaccaatgatcccggaccggctatcccagagaacgatatctcaagattcaattataaccgcctggtaacttacacagatcaggtgataatcccgctgattaaccatgcccgcagcctgggaatgtatgtcatcctacgtccgccaggcgtatgtccaaatcgtattgctgtgaacgatgcctatcatagctatcttaaaaccgtatggacctttttgtcgcaacatccggggctaaagaacgctgacaatgtgatgttcgaattagccaacgaacctgttgagattctgggtacaaatggcacatggggatcgacaggaaacgagcactttgcagcacttaaaaacttcttccagccattagttaacatcattcgcaacaatggagccaataatgtttgctggataccgggtacaggatggcaatcccattaccaaggctatgtcaataaccagattacaggtggtaatattggttatgctgttcatatctatccggcttactggggcggtctcagcaactatcaagcctttcagaatgcatggaatatcaatgttaaaccaatcgcagacattgcaccaattgccattaccgagaccgactgggcaccgcagggttatggtaccttcggtatcggtacaacaggtacggcaggcggaagcggatttggcgccaatttaaaatatatcgtggatcagtcaggcaatgtaagctggaatgttcttgccccggataatctcctccacaaaggcgatcctaatgcaggaacagcctacaacaacgattgggaagcctgcgccgcaccagttaaacagtggttccagcaatatgcatcctccaattatcctgttggaaactgtaatacaaccagcagcctggttaataatggcatttacgaaatcgagtttcagaccgatgccaataaagtagttgatctaaaatccggagaggatgccaatggcgcagtgttaagaccatggacaaggaatggtgctgctgcacagcgctgggttgcaattgacgccggcaatggttactggcgttttgtatccaaagcgagtgcaaccaatcgctgcattgacttagccagtaacagcaatacactgggaacctcgatcaggctttggcagaactatggtaatgatgcacaagcctggcaggtagttgctgtctccaatggttattataaaatcctgtccaaggtggaccctacacgtggctgggatattcccaactgtaccatggatggcaattcaaacttacacctttgggattattatggtacgtcctgtcagttgttcaagttcaaatatattgggatgaactga

SEQ ID NO: 29 - protein, 585 aa, Artificial sequence
  Synthetic Construct
MKKPLGKIVASTALLISVAFSSSIASAHHHHHHPRDEKNLLEDPDSNLSAGASARALAATPMLHVGGRYLKDPCDNNVVLHGVAITPSPWFNGCQYGANSGYCTWDNYNVQGALNYNKAVMNKLTSAADGWYLNYIRLHIDPYWTNDPGPAIPENDISRFNYNRLVTYTDQVIIPLINHARSLGMYVILRPPGVCPNRIAVNDAYHSYLKTVWTFLSQHPGLKNADNVMFELANEPVEILGTNGTWGSTGNEHFAALKNFFQPLVNIIRNNGANNVCWIPGTGWQSHYQGYVNNQITGGNIGYAVHIYPAYWGGLSNYQAFQNAWNINVKPIADIAPIAITETDWAPQGYGTFGIGTTGTAGGSGFGANLKYIVDQSGNVSWNVLAPDNLLHKGDPNAGTAYNNDWEACAAPVKQWFQQYASSNYPVGNCNTTSSLVNNGIYEIEFQTDANKVVDLKSGEDANGAVLRPWTRNGAAAQRWVAIDAGNGYWRFVSKASATNRCIDLASNSNTLGTSIRLWQNYGNDAQAWQVVAVSNGYYKILSKVDPTRGWDIPNCTMDGNSNLHLWDYYGTSCQLFKFKYIGMN

SEQ ID NO: 30 - protein, 558 aa, Artificial sequence
  Synthetic construct
  mat_peptide (1)..(558)
HHHHHHPRDEKNLLEDPDSNLSAGASARALAATPMLHVGGRYLKDPCDNNVVLHGVAITPSPWFNGCQYGANSGYCTWDNYNVQGALNYNKAVMNKLTSAADGWYLNYIRLHIDPYWTNDPGPAIPENDISRFNYNRLVTYTDQVIIPLINHARSLGMYVILRPPGVCPNRIAVNDAYHSYLKTVWTFLSQHPGLKNADNVMFELANEPVEILGTNGTWGSTGNEHFAALKNFFQPLVNIIRNNGANNVCWIPGTGWQSHYQGYVNNQITGGNIGYAVHIYPAYWGGLSNYQAFQNAWNINVKPIADIAPIAITETDWAPQGYGTFGIGTTGTAGGSGFGANLKYIVDQSGNVSWNVLAPDNLLHKGDPNAGTAYNNDWEACAAPVKQWFQQYASSNYPVGNCNTTSSLVNNGIYEIEFQTDANKVVDLKSGEDANGAVLRPWTRNGAAAQRWVAIDAGNGYWRFVSKASATNRCIDLASNSNTLGTSIRLWQNYGNDAQAWQVVAVSNGYYKILSKVDPTRGWDIPNCTMDGNSNLHLWDYYGTSCQLFKFKYIGMN

SEQ ID NO: 31 - DNA, 1971 bp, Unknown
  Elephant dung metagenome
  CDS (1)..(1968)
  sig_peptide (1)..(75)
  mat_peptide (76)..(1968)
atgaagaaactattcttgttgctgttggcatctgttttgacgctgacctgtgcgactacatttacatcatgtgataaggacgaggatcctattgaagaaccagatcctacaccagaggagcagcctgaaaataaacctgccaacacgaacatccaggcagggaagtatggtccgcttcatattgatgggcgttacctctgtgattcaaacaacgttcacgtaaatcttcatggcttttggcagacttacagcccttggttcaatggtggagcatggggcgaggacaactggggaaattatgatgttgatgcatgtctcgaatacaaccagaaggaaatcgataagatcttgaagtgcggttggaaggttgatttcatgcgtgtgcatatggatagctattggagtctctcccgtagccgccagtatggaacagatcgtgcggagtggcaggatttcaaagaggtacttttccaacagtatctcgatgaagtgtttgttccaatgatcgaacattgtattgatagaggcctctatgtagttctcatgccaggttattcttcgcctgaatatctcgaatatggggacggtttcttcaaggtgcttgagaaactttggaaaaacatcagtacccataaggacttatgcaacaatccgaatgtgatgtttgagatcgtcaatgagcctcgttcgatgaagaaggatggcaaggctctggcaggtactagtgacgcaagcaataaggcactcacggaatatatgcagcattttgtcgatcttatccgtgagaatgccaacaacattatctgggtgcctggtaccggctatcagagccagtatgctggttatgcgaagtaccgtctttctggcgataatcttggttttgctgtacactgttacccaggttggtatggaagtgatgcagaacaggagagtgccgagttaggtggtggtatgggcggtggatatactgccttccgtgcaggttgggatgctcagattacccctgctgctaatattgctccaatcatggttactgagatggactgggctcctgctaagtataataaatcttggggaaagagctttactggcgaagccggaggaagtggcttcggtgcaaactttaagtatcttgctgatatgacaggcaatgtttcttatatcctgtttacggcaccaaatgatttggccgactacagtgcgatgtctgttaaacctaccactaattattggaatgatccgaagggctgtccatggcagatctatcattggtatcaggaatatgcagagggtcgagtacaaccactgacggcaagtcagcttaagatcggtggtagtcagaatggcaaacttacgctctctgttggcactacaacagatttgattgtcaatgctatacaatctggagatgtcgtttatcctttgcagtctggcgttgagattcaatcatcaaattcttctgtcgtgaaggtgaaaggaactcaggttgaagctgtgaatgagggagaagcaactcttactgtttctgctctcggaatgacttcgacttgcaacgtgactgttggaagcctgttcccactgacgaatgaaagtttcaatccaagcatttgggaaactggatcattcgatgaatcaacccatacattcatctctggtacctatggctttggtggttggcagttcgggggtattgatattacgggacatcagtatattgtcgctaagttaggtgctggttccgatatgtcttgtagtccatccttccgtttgttcgatgacaagggctattggggtggcgctgtcgagtgttctttcaaaaaccgagaggctcgtatcgaaattgcttcgatgaagagaacaaaggataatagccttgtcgatgatttcgatgctacgaatgttacgattgtaggattctggacaacgggaggtaagccaatcgttatcgaaagtgtaggtttcgaggattga

SEQ ID NO: 32 - protein, 656 aa, Unknown
  Synthetic Construct
MKKLFLLLLASVLTLTCATTFTSCDKDEDPIEEPDPTPEEQPENKPANTNIQAGKYGPLHIDGRYLCDSNNVHVNLHGFWQTYSPWFNGGAWGEDNWGNYDVDACLEYNQKEIDKILKCGWKVDFMRVHMDSYWSLSRSRQYGTDRAEWQDFKEVLFQQYLDEVFVPMIEHCIDRGLYVVLMPGYSSPEYLEYGDGFFKVLEKLWKNISTHKDLCNNPNVMFEIVNEPRSMKKDGKALAGTSDASNKALTEYMQHFVDLIRENANNIIWVPGTGYQSQYAGYAKYRLSGDNLGFAVHCYPGWYGSDAEQESAELGGGMGGGYTAFRAGWDAQITPAANIAPIMVTEMDWAPAKYNKSWGKSFTGEAGGSGFGANFKYLADMTGNVSYILFTAPNDLADYSAMSVKPTTNYWNDPKGCPWQIYHWYQEYAEGRVQPLTASQLKIGGSQNGKLTLSVGTTTDLIVNAIQSGDVVYPLQSGVEIQSSNSSVVKVKGTQVEAVNEGEATLTVSALGMTSTCNVTVGSLFPLTNESFNPSIWETGSFDESTHTFISGTYGFGGWQFGGIDITGHQYIVAKLGAGSDMSCSPSFRLFDDKGYWGGAVECSFKNREARIEIASMKRTKDNSLVDDFDATNVTIVGFWTTGGKPIVIESVGFED

SEQ ID NO: 33 - protein, 631 aa, Unknown
  Elephant dung metagenome
  mat_peptide (1)..(631)
KDEDPIEEPDPTPEEQPENKPANTNIQAGKYGPLHIDGRYLCDSNNVHVNLHGFWQTYSPWFNGGAWGEDNWGNYDVDACLEYNQKEIDKILKCGWKVDFMRVHMDSYWSLSRSRQYGTDRAEWQDFKEVLFQQYLDEVFVPMIEHCIDRGLYVVLMPGYSSPEYLEYGDGFFKVLEKLWKNISTHKDLCNNPNVMFEIVNEPRSMKKDGKALAGTSDASNKALTEYMQHFVDLIRENANNIIWVPGTGYQSQYAGYAKYRLSGDNLGFAVHCYPGWYGSDAEQESAELGGGMGGGYTAFRAGWDAQITPAANIAPIMVTEMDWAPAKYNKSWGKSFTGEAGGSGFGANFKYLADMTGNVSYILFTAPNDLADYSAMSVKPTTNYWNDPKGCPWQIYHWYQEYAEGRVQPLTASQLKIGGSQNGKLTLSVGTTTDLIVNAIQSGDVVYPLQSGVEIQSSNSSVVKVKGTQVEAVNEGEATLTVSALGMTSTCNVTVGSLFPLTNESFNPSIWETGSFDESTHTFISGTYGFGGWQFGGIDITGHQYIVAKLGAGSDMSCSPSFRLFDDKGYWGGAVECSFKNREARIEIASMKRTKDNSLVDDFDATNVTIVGFWTTGGKPIVIESVGFED

SEQ ID NO: 34 - DNA, 2001 bp, Artificial sequence
  Synthetic construct
  CDS (1)..(1998)
  sig_peptide (1)..(81)
  mat_peptide (82)..(1998)
atgaagaaaccgttggggaaaattgtcgcaagcaccgcactactcatttctgttgcttttagttcatcgatagcatcagcacatcatcatcaccatcatcctaggaaggacgaggatcctattgaagaaccagatcctacaccagaggagcagcctgaaaataaacctgccaacacgaacatccaggcagggaagtatggtccgcttcatattgatgggcgttacctctgtgattcaaacaacgttcacgtaaatcttcatggcttttggcagacttacagcccttggttcaatggtggagcatggggcgaggacaactggggaaattatgatgttgatgcatgtctcgaatacaaccagaaggaaatcgataagatcttgaagtgcggttggaaggttgatttcatgcgtgtgcatatggatagctattggagtctctcccgtagccgccagtatggaacagatcgtgcggagtggcaggatttcaaagaggtacttttccaacagtatctcgatgaagtgtttgttccaatgatcgaacattgtattgatagaggcctctatgtagttctcatgccaggttattcttcgcctgaatatctcgaatatggggacggtttcttcaaggtgcttgagaaactttggaaaaacatcagtacccataaggacttatgcaacaatccgaatgtgatgtttgagatcgtcaatgagcctcgttcgatgaagaaggatggcaaggctctggcaggtactagtgacgcaagcaataaggcactcacggaatatatgcagcattttgtcgatcttatccgtgagaatgccaacaacattatctgggtgcctggtaccggctatcagagccagtatgctggttatgcgaagtaccgtctttctggcgataatcttggttttgctgtacactgttacccaggttggtatggaagtgatgcagaacaggagagtgccgagttaggtggtggtatgggcggtggatatactgccttccgtgcaggttgggatgctcagattacccctgctgctaatattgctccaatcatggttactgagatggactgggctcctgctaagtataataaatcttggggaaagagctttactggcgaagccggaggaagtggcttcggtgcaaactttaagtatcttgctgatatgacaggcaatgtttcttatatcctgtttacggcaccaaatgatttggccgactacagtgcgatgtctgttaaacctaccactaattattggaatgatccgaagggctgtccatggcagatctatcattggtatcaggaatatgcagagggtcgagtacaaccactgacggcaagtcagcttaagatcggtggtagtcagaatggcaaacttacgctctctgttggcactacaacagatttgattgtcaatgctatacaatctggagatgtcgtttatcctttgcattctggcgttgagattcaatcatcaaattcttctgtcgtgaaggtgaaaggaactcaggttgaagctgtgaatgagggagaagcaactcttactgtttctgctctcggaatgacttcgacttgcaacgtgactgttggaagcctgttcccactgacgaatgaaagtttcaatccaagcatttgggaaactggatcattcgatgaatcaacccatacattcatctctggtacctatggctttggtggttggcagttcgggggtattgatattacgggacatcagtatattgtcgctaagttaggtgctggttccgatatgtcttgtagtccatccttccgtttgttcgatgacaagggctattggggtggcgctgtcgagtgttctttcaaaaaccgagaggctcgtatcgaaattgcttcgatgaagagaacaaaggataatagccttgtcgatgatttcgatgctacgaatgttacgattgtaggattctggacaacgggaggtaagccaatcgttatcgaaagtgtaggtttcgaggattga

SEQ ID NO: 35 - protein, 666 aa, Artificial sequence
  Synthetic Construct
MKKPLGKIVASTALLISVAFSSSIASAHHHHHHPRKDEDPIEEPDPTPEEQPENKPANTNIQAGKYGPLHIDGRYLCDSNNVHVNLHGFWQTYSPWFNGGAWGEDNWGNYDVDACLEYNQKEIDKILKCGWKVDFMRVHMDSYWSLSRSRQYGTDRAEWQDFKEVLFQQYLDEVFVPMIEHCIDRGLYVVLMPGYSSPEYLEYGDGFFKVLEKLWKNISTHKDLCNNPNVMFEIVNEPRSMKKDGKALAGTSDASNKALTEYMQHFVDLIRENANNIIWVPGTGYQSQYAGYAKYRLSGDNLGFAVHCYPGWYGSDAEQESAELGGGMGGGYTAFRAGWDAQITPAANIAPIMVTEMDWAPAKYNKSWGKSFTGEAGGSGFGANFKYLADMTGNVSYILFTAPNDLADYSAMSVKPTTNYWNDPKGCPWQIYHWYQEYAEGRVQPLTASQLKIGGSQNGKLTLSVGTTTDLIVNAIQSGDVVYPLHSGVEIQSSNSSVVKVKGTQVEAVNEGEATLTVSALGMTSTCNVTVGSLFPLTNESFNPSIWETGSFDESTHTFISGTYGFGGWQFGGIDITGHQYIVAKLGAGSDMSCSPSFRLFDDKGYWGGAVECSFKNREARIEIASMKRTKDNSLVDDFDATNVTIVGFWTTGGKPIVIESVGFED

SEQ ID NO: 36 - protein, 639 aa, Artificial sequence
  Synthetic construct
  mat_peptide (1)..(639)
HHHHHHPRKDEDPIEEPDPTPEEQPENKPANTNIQAGKYGPLHIDGRYLCDSNNVHVNLHGFWQTYSPWFNGGAWGEDNWGNYDVDACLEYNQKEIDKILKCGWKVDFMRVHMDSYWSLSRSRQYGTDRAEWQDFKEVLFQQYLDEVFVPMIEHCIDRGLYVVLMPGYSSPEYLEYGDGFFKVLEKLWKNISTHKDLCNNPNVMFEIVNEPRSMKKDGKALAGTSDASNKALTEYMQHFVDLIRENANNIIWVPGTGYQSQYAGYAKYRLSGDNLGFAVHCYPGWYGSDAEQESAELGGGMGGGYTAFRAGWDAQITPAANIAPIMVTEMDWAPAKYNKSWGKSFTGEAGGSGFGANFKYLADMTGNVSYILFTAPNDLADYSAMSVKPTTNYWNDPKGCPWQIYHWYQEYAEGRVQPLTASQLKIGGSQNGKLTLSVGTTTDLIVNAIQSGDVVYPLHSGVEIQSSNSSVVKVKGTQVEAVNEGEATLTVSALGMTSTCNVTVGSLFPLTNESFNPSIWETGSFDESTHTFISGTYGFGGWQFGGIDITGHQYIVAKLGAGSDMSCSPSFRLFDDKGYWGGAVECSFKNREARIEIASMKRTKDNSLVDDFDATNVTIVGFWTTGGKPIVIESVGFED

SEQ ID NO: 37 - DNA, 2541 bp, Unknown
  Elephant dung Metagenome
  CDS (1)..(2538)
  sig_peptide (1)..(54)
  mat_peptide (55)..(2538)
atgaaaaaattctacaaggctatagtggcatttctaaccttaccactcgccgcattcggacaattcggtgttgtccagccgctccacgtgaatggcaatcagtttaatgacccctatggaaacaaggtagtccttcacggtgtgatggacactccaagcccatatttcaacagttggagatggggatattcttgtaatgacggagccgtttctggctgtctcaactatttcgagaagatcttcaccgctattacagacacaaagcaaggtgcttattgtaacttgttccgtctccacctcgatccatgctggactaacgatccaaacaagacagctactggttctgagacgggagaagcaaacattagtcgtttcagcaacgaccgtcttgtaaagtatctgaataccgtatactggccaatcgcacagaaggctctcaaccacggtatgtacgtcattatgcgtcctcctggcgtatgccctgataatcttcgcgttggcgatgcttatcagaactatctcaaaacagtatggaatacagtcactaagaaccagaatgtgattaagaactctggtgttgtaatgattgaacttgcaaacgagccaatccatatctacaatcaatatggacaggcttctgcaacagctatgcgtgactatttccagcctgtgatagatgttatacgtaaaaatggttacacaggtatcatcctcgttcctggaacaggttggcagtcaaactacaaggattatgacaagtatcctgtaaatgacaacaactacggctatgccgttcacgactacccaggttggtacagcacaagtgaccagagctatgatcacaacacagcaatccgtgctttcggggataatgttcctgtagtaaagaagaaacctatcgtgatcacagaggttgactggagtccagagaaagcaggaacaggtcattataatgagcacggacagtgggtaacaagcaactacggtacctgggcaacagcctcaactacaaagtggggttatgcttacaaagctgtgcttgactactacgacaacatctcaatgacactttccggaacagacacatacattgatgtggacacataccttaattctggtaaggttactggtgcattcggtaacatctgggaagcttgtggtgctgcttgtatgtattggtacaagctctgggctcagaaggattatgctcacgcaacaggttctagttctagttcaaccactacgcaaccatctacaggaggtagtacatcaacaggtagtactacaacaggcaatggtgaatttactaacgtagacctctcatcatcactcatcccaggatggtctcaaggtggcgttcgtcctaatggatgggcttgtaatgatgcaggcgactatccagcgtctggtgaggcaggctctggtccacgtgtaatgcagttcaatggtggtggcgacttcaagtacggattctatttccgtcagcaggacgcaagcaagcctggttatattcagtacggtacaacaagtggctacgaactcgctctcaacagtttcggaaactattgtctcacattcaactgtgcagcttgggctggttcaccttatgtaaaggcagaggttatcacttcttctggtaatgtcattgcaagcactatcgtcaagtgcaatctcaacctcaacaagaacactaatgcaagcacagcaaaatcagatcagggctatctcagtttctatgtcctcaacaagggtaacttctctgtcaagttcactccatgtgctgatgctaatggtggttcaggtacttgggtagaggctgtcgtaggtaacatcaacctccgttatatgggtaacccactctcattcgagaaagcaaactacgtaaatccaggttggaagatacttgacggtggcaagattgttgagacaggagacgctggttctggccctcgtatcttcaacttccctgctggaggtcagttcaactatggtctttacatccgcagtacaagcacagaactctcagagaactatgctgagtttggttcacgttggggatatggattgaacttcctcccaggtcgctacactctcacatataactgcgcagcatggacaggttcaccatacgtgaagtgtgaagttatcaatgagaatgatcaggttgttgcaagcagcattacaaactgttcactcaacctcaacaagaacctcaatgcatctactgcaaatgcacctcagggttcagtatcattcacagtaagcaacactggtagctacaagctgcgttggacaccagtcgcaaatgcaaacggtgatgcaggttactgggtagaggctgtcattggtcatatcaagatcacacagaactcaggcaacaaggttgctgcatacacagatgacaacgatgaagtcacatctgttgcagaagtagaaaacgaagcaaactcagaggagacattcaacctctctggtcagcgtgttgaaaacccaactaagggtatctatataaagaatggaaagaaggtaatcgttaggtaa

SEQ ID NO: 38 - protein, 846 aa, Unknown
  Synthetic Construct
MKKFYKAIVAFLTLPLAAFGQFGVVQPLHVNGNQFNDPYGNKVVLHGVMDTPSPYFNSWRWGYSCNDGAVSGCLNYFEKIFTAITDTKQGAYCNLFRLHLDPCWTNDPNKTATGSETGEANISRFSNDRLVKYLNTVYWPIAQKALNHGMYVIMRPPGVCPDNLRVGDAYQNYLKTVWNTVTKNQNVIKNSGVVMIELANEPIHIYNQYGQASATAMRDYFQPVIDVIRKNGYTGIILVPGTGWQSNYKDYDKYPVNDNNYGYAVHDYPGWYSTSDQSYDHNTAIRAFGDNVPVVKKKPIVITEVDWSPEKAGTGHYNEHGQWVTSNYGTWATASTTKWGYAYKAVLDYYDNISMTLSGTDTYIDVDTYLNSGKVTGAFGNIWEACGAACMYWYKLWAQKDYAHATGSSSSSTTTQPSTGGSTSTGSTTTGNGEFTNVDLSSSLIPGWSQGGVRPNGWACNDAGDYPASGEAGSGPRVMQFNGGGDFKYGFYFRQQDASKPGYIQYGTTSGYELALNSFGNYCLTFNCAAWAGSPYVKAEVITSSGNVIASTIVKCNLNLNKNTNASTAKSDQGYLSFYVLNKGNFSVKFTPCADANGGSGTWVEAVVGNINLRYMGNPLSFEKANYVNPGWKILDGGKIVETGDAGSGPRIFNFPAGGQFNYGLYIRSTSTELSENYAEFGSRWGYGLNFLPGRYTLTYNCAAWTGSPYVKCEVINENDQVVASSITNCSLNLNKNLNASTANAPQGSVSFTVSNTGSYKLRWTPVANANGDAGYWVEAVIGHIKITQNSGNKVAAYTDDNDEVTSVAEVENEANSEETFNLSGQRVENPTKGIYIKNGKKVIVR

SEQ ID NO: 39 - protein, 828 aa, Unknown
  Elephant dung metagenome
  mat_peptide (1)..(828)
FGQFGVVQPLHVNGNQFNDPYGNKVVLHGVMDTPSPYFNSWRWGYSCNDGAVSGCLNYFEKIFTAITDTKQGAYCNLFRLHLDPCWTNDPNKTATGSETGEANISRFSNDRLVKYLNTVYWPIAQKALNHGMYVIMRPPGVCPDNLRVGDAYQNYLKTVWNTVTKNQNVIKNSGVVMIELANEPIHIYNQYGQASATAMRDYFQPVIDVIRKNGYTGIILVPGTGWQSNYKDYDKYPVNDNNYGYAVHDYPGWYSTSDQSYDHNTAIRAFGDNVPVVKKKPIVITEVDWSPEKAGTGHYNEHGQWVTSNYGTWATASTTKWGYAYKAVLDYYDNISMTLSGTDTYIDVDTYLNSGKVTGAFGNIWEACGAACMYWYKLWAQKDYAHATGSSSSSTTTQPSTGGSTSTGSTTTGNGEFTNVDLSSSLIPGWSQGGVRPNGWACNDAGDYPASGEAGSGPRVMQFNGGGDFKYGFYFRQQDASKPGYIQYGTTSGYELALNSFGNYCLTFNCAAWAGSPYVKAEVITSSGNVIASTIVKCNLNLNKNTNASTAKSDQGYLSFYVLNKGNFSVKFTPCADANGGSGTWVEAVVGNINLRYMGNPLSFEKANYVNPGWKILDGGKIVETGDAGSGPRIFNFPAGGQFNYGLYIRSTSTELSENYAEFGSRWGYGLNFLPGRYTLTYNCAAWTGSPYVKCEVINENDQVVASSITNCSLNLNKNLNASTANAPQGSVSFTVSNTGSYKLRWTPVANANGDAGYWVEAVIGHIKITQNSGNKVAAYTDDNDEVTSVAEVENEANSEETFNLSGQRVENPTKGIYIKNGKKVIVR

SEQ ID NO: 40 - DNA, 2592 bp, Artificial sequence
  Synthetic construct
  CDS (1)..(2589)
  sig_peptide (1)..(81)
  mat_peptide (82)..(2589)
atgaagaaaccgttggggaaaattgtcgcaagcaccgcactactcatttctgttgcttttagttcatcgatagcatcagcacatcatcatcaccatcatcctaggttcggacaattcggtgttgtccagccgctccacgtgaatggcaatcagtttaatgacccctatggaaacaaggtagtccttcacggtgtgatggacactccaagcccatatttcaacagttggagatggggatattcttgtaatgacggagccgtttctggctgtctcaactatttcgagaagatcttcaccgctattacagacacaaagcaaggtgcttattgtaacttgttccgtctccacctcgatccatgctggactaacgatccaaacaagacagctactggttctgagacgggagaagcaaacattagtcgtttcagcaacgaccgtcttgtaaagtatctgaataccgtatactggccaatcgcacagaaggctctcaaccacggtatgtacgtcattatgcgtcctcctggcgtatgccctgataatcttcgcgttggcgatgcttatcagaactatctcaaaacagtatggaatacagtcactaagaaccagaatgtgattaagaactctggtgttgtaatgattgaacttgcaaacgagccaatccatatctacaatcaatatggacaggcttctgcaacagctatgcgtgactatttccagcctgtgatagatgttatacgtaaaaatggttacacaggtatcatcctcgttcctggaacaggttggcagtcaaactacaaggattatgacaagtatcctgtaaatgacaacaactacggctatgccgttcacgactacccaggttggtacagcacaagtgaccagagctatgatcacaacacagcaatccgtgctttcggggataatgttcctgtagtaaagaagaaacctatcgtgatcacagaggttgactggagtccagagaaagcaggaacaggtcattataatgagcacggacagtgggtaacaagcaactacggtacctgggcaacagcctcaactacaaagtggggttatgcttacaaagctgtgcttgactactacgacaacatctcaatgacactttccggaacagacacatacattgatgtggacacataccttaattctggtaaggttactggtgcattcggtaacatctgggaagcttgtggtgctgcttgtatgtattggtacaagctctgggctcagaaggattatgctcacgcaacaggttctagttctagttcaaccactacgcaaccatctacaggaggtagtacatcaacaggtagtactacaacaggcaatggtgaatttactaacgtagacctctcatcatcactcatcccaggatggtctcaaggtggcgttcgtcctaatggatgggcttgtaatgatgcaggcgactatccagcgtctggtgaggcaggctctggtccacgtgtaatgcagttcaatggtggtggcgacttcaagtacggattctatttccgtcagcaggacgcaagcaagcctggttatattcagtacggtacaacaagtggctacgaactcgctctcaacagtttcggaaactattgtctcacattcaactgtgcagcttgggctggttcaccttatgtaaaggcagaggttatcacttcttctggtaatgtcattgcaagcactatcgtcaagtgcaatctcaacctcaacaagaacactaatgcaagcacagcaaaatcagatcagggctatctcagtttctatgtcctcaacaagggtaacttctctgtcaagttcactccatgtgctgatgctaatggtggttcaggtacttgggtagaggctgtcgtaggtaacatcaacctccgttatatgggtaacccactctcattcgagaaagcaaactacgtaaatccaggttggaagatacttgacggtggcaagattgttgagacaggagacgctggttctggccctcgtatcttcaacttccctgctggaggtcagttcaactatggtctttacatccgcagtacaagcacagaactctcagagaactatgctgagtttggttcacgttggggatatggattgaacttcctcccaggtcgctacactctcacatataactgcgcagcatggacaggttcaccatacgtgaagtgtgaagttatcaatgagaatgatcaggttgttgcaagcagcattacaaactgttcactcaacctcaacaagaacctcaatgcatctactgcaaatgcacctcagggttcagtatcattcacagtaagcaacactggtagctacaagctgcgttggacaccagtcgcaaatgcaaacggtgatgcaggttactgggtagaggctgtcattggtcatatcaagatcacacagaactcaggcaacaaggttgctgcatacacagatgacaacgatgaagtcacatctgttgcagaagtagaaaacgaagcaaactcagaggagacattcaacctctctggtcagcgtgttgaaaacccaactaagggtatctatataaagaatggaaagaaggtaatcgttaggtaa

SEQ ID NO: 41 - protein, 863 aa, Artificial sequence
  Synthetic Construct
MKKPLGKIVASTALLISVAFSSSIASAHHHHHHPRFGQFGVVQPLHVNGNQFNDPYGNKVVLHGVMDTPSPYFNSWRWGYSCNDGAVSGCLNYFEKIFTAITDTKQGAYCNLFRLHLDPCWTNDPNKTATGSETGEANISRFSNDRLVKYLNTVYWPIAQKALNHGMYVIMRPPGVCPDNLRVGDAYQNYLKTVWNTVTKNQNVIKNSGVVMIELANEPIHIYNQYGQASATAMRDYFQPVIDVIRKNGYTGIILVPGTGWQSNYKDYDKYPVNDNNYGYAVHDYPGWYSTSDQSYDHNTAIRAFGDNVPVVKKKPIVITEVDWSPEKAGTGHYNEHGQWVTSNYGTWATASTTKWGYAYKAVLDYYDNISMTLSGTDTYIDVDTYLNSGKVTGAFGNIWEACGAACMYWYKLWAQKDYAHATGSSSSSTTTQPSTGGSTSTGSTTTGNGEFTNVDLSSSLIPGWSQGGVRPNGWACNDAGDYPASGEAGSGPRVMQFNGGGDFKYGFYFRQQDASKPGYIQYGTTSGYELALNSFGNYCLTFNCAAWAGSPYVKAEVITSSGNVIASTIVKCNLNLNKNTNASTAKSDQGYLSFYVLNKGNFSVKFTPCADANGGSGTWVEAVVGNINLRYMGNPLSFEKANYVNPGWKILDGGKIVETGDAGSGPRIFNFPAGGQFNYGLYIRSTSTELSENYAEFGSRWGYGLNFLPGRYTLTYNCAAWTGSPYVKCEVINENDQVVASSITNCSLNLNKNLNASTANAPQGSVSFTVSNTGSYKLRWTPVANANGDAGYWVEAVIGHIKITQNSGNKVAAYTDDNDEVTSVAEVENEANSEETFNLSGQRVENPTKGIYIKNGKKVIVR

SEQ ID NO: 42 - protein, 836 aa, Artificial sequence
  Synthetic construct
  mat_peptide (1)..(836)
HHHHHHPRFGQFGVVQPLHVNGNQFNDPYGNKVVLHGVMDTPSPYFNSWRWGYSCNDGAVSGCLNYFEKIFTAITDTKQGAYCNLFRLHLDPCWTNDPNKTATGSETGEANISRFSNDRLVKYLNTVYWPIAQKALNHGMYVIMRPPGVCPDNLRVGDAYQNYLKTVWNTVTKNQNVIKNSGVVMIELANEPIHIYNQYGQASATAMRDYFQPVIDVIRKNGYTGIILVPGTGWQSNYKDYDKYPVNDNNYGYAVHDYPGWYSTSDQSYDHNTAIRAFGDNVPVVKKKPIVITEVDWSPEKAGTGHYNEHGQWVTSNYGTWATASTTKWGYAYKAVLDYYDNISMTLSGTDTYIDVDTYLNSGKVTGAFGNIWEACGAACMYWYKLWAQKDYAHATGSSSSSTTTQPSTGGSTSTGSTTTGNGEFTNVDLSSSLIPGWSQGGVRPNGWACNDAGDYPASGEAGSGPRVMQFNGGGDFKYGFYFRQQDASKPGYIQYGTTSGYELALNSFGNYCLTFNCAAWAGSPYVKAEVITSSGNVIASTIVKCNLNLNKNTNASTAKSDQGYLSFYVLNKGNFSVKFTPCADANGGSGTWVEAVVGNINLRYMGNPLSFEKANYVNPGWKILDGGKIVETGDAGSGPRIFNFPAGGQFNYGLYIRSTSTELSENYAEFGSRWGYGLNFLPGRYTLTYNCAAWTGSPYVKCEVINENDQVVASSITNCSLNLNKNLNASTANAPQGSVSFTVSNTGSYKLRWTPVANANGDAGYWVEAVIGHIKITQNSGNKVAAYTDDNDEVTSVAEVENEANSEETFNLSGQRVENPTKGIYIKNGKKVIVR

SEQ ID NO: 43 - DNA, 1794 bp, Unknown
  Elephant dung metagenome
  CDS (1)..(1791)
  sig_peptide (1)..(63)
  mat_peptide (64)..(1791)
atgaaaagatacctgcttatacttgtctcgtttatgatgttacatctctgcatccaggcagagacactctctccattgcatgtggaaggacgttggctttgtaacgaaaacggagaacatgtcaacctgcatggcttcggtcagacgtatagcccttggttcaacgaacagggcaacggttggggctggggctacagcgtcagtgactgtatgaaatacaacaagggactcattgataagattattagcgctggttggaagatgaactggcttcgtctgcacatggatccccattggagcaacactccgggtgtaagtacatcgggcgagaacgacatctcggcttttaatgagtctcgtttccgtacctatctgaacagtctgttcatcccgatggccgaatatgccaatcagcatggcatgtacgttgtgatgcgtccccctggagtctgtccggagaagatagagatcggaggcgcctactacaagtatctgctcaaggtgtggggcattgtggccagcaacgagaagttgaagaacaatcctggcatcatgttcgagttggccaacgagccaatcaacatcaaaggtaccgacggtcagtatacttcgtacagcgacggaagcaaccagaacatgaccaagttctttcaggccatcgtcgatagcatccgttcgtgtggagccaacaacatcctttgggtgccgggtctgggctatcagtcgcaatatgcaggattcgtcaaatatcctatccaaggcgagaatatcggctatgcggtacactgctacccgggctggtatggttccgatagcgaggccgatggtggcagtgtcgaacagggcgtagtcaccaagggagccggttattccgaattcaaggccggctgggataatcaggtgggaccagtcgccaagatcgccccgattctcatcaccgagatggattgggccccgaaatcatataattgttcgtggggtaaggctaccacaggtgtggctggtggcgttggcttcggcgccaacttcaagtacatcgtcgataagaccggcaacgtctcatggatgctcttcaccggaccggaacatctggctaagtatgttgacagcaaagccgatggcaagacctttttgaccgacccggaggcatgtgtccgtccaatctatcgttggttcaaggagtataccgatccgaactgggtcttcgaagatacgttagcgagccaaacgatgtatttcccgcagaccgacacctggatcaatccaagcatttgggagaagggttcgttcgatgccacgacaggagcgctcgtcacgggtcaatatggcttcggcggctggcagttcggtactggattggatctctcgaagtggaaatatctggtcatcaagctcaagcagaccgcatcatcgggcggatggtcgttccgtgtcttcgacgagaacagctattggtccaattgctaccagaagtcggtcggttccagtctgcgtgccatcgttcctttgaatggaatgtataagaccatcgacggttcggtgtcaaattcgtccaaagtcaatccgtcgcatatctatatcgcaggattctggagctatggtggcacaccgctctacatcgacaagctctatctgaccaaccaatcggactattcggaggaggtcggactggaacaagtcgcgcaagacgatgatgttcctatcgttatgttcgatgttatgggtcgtcgcgtagaaacaccgcatcgtggaggcttctacatgagcaaagaccgaaaattcattgtacgttaa

SEQ ID NO: 44 - protein, 597 aa, Unknown
  Synthetic Construct
MKRYLLILVSFMMLHLCIQAETLSPLHVEGRWLCNENGEHVNLHGFGQTYSPWFNEQGNGWGWGYSVSDCMKYNKGLIDKIISAGWKMNWLRLHMDPHWSNTPGVSTSGENDISAFNESRFRTYLNSLFIPMAEYANQHGMYVVMRPPGVCPEKIEIGGAYYKYLLKVWGIVASNEKLKNNPGIMFELANEPINIKGTDGQYTSYSDGSNQNMTKFFQAIVDSIRSCGANNILWVPGLGYQSQYAGFVKYPIQGENIGYAVHCYPGWYGSDSEADGGSVEQGVVTKGAGYSEFKAGWDNQVGPVAKIAPILITEMDWAPKSYNCSWGKATTGVAGGVGFGANFKYIVDKTGNVSWMLFTGPEHLAKYVDSKADGKTFLTDPEACVRPIYRWFKEYTDPNWVFEDTLASQTMYFPQTDTWINPSIWEKGSFDATTGALVTGQYGFGGWQFGTGLDLSKWKYLVIKLKQTASSGGWSFRVFDENSYWSNCYQKSVGSSLRAIVPLNGMYKTIDGSVSNSSKVNPSHIYIAGFWSYGGTPLYIDKLYLTNQSDYSEEVGLEQVAQDDDVPIVMFDVMGRRVETPHRGGFYMSKDRKFIVR

SEQ ID NO: 45 - protein, 577 aa, Unknown
  Elephant dung metagenome
  mat_peptide (1)..(577)
ETLSPLHVEGRWLCNENGEHVNLHGFGQTYSPWFNEQGNGWGWGYSVSDCMKYNKGLIDKIISAGWKMNWLRLHMDPHWSNTPGVSTSGENDISAFNESRFRTYLNSLFIPMAEYANQHGMYVVMRPPGVCPEKIEIGGAYYKYLLKVWGIVASNEKLKNNPGIMFELANEPINIKGTDGQYTSYSDGSNQNMTKFFQAIVDSIRSCGANNILWVPGLGYQSQYAGFVKYPIQGENIGYAVHCYPGWYGSDSEADGGSVEQGVVTKGAGYSEFKAGWDNQVGPVAKIAPILITEMDWAPKSYNCSWGKATTGVAGGVGFGANFKYIVDKTGNVSWMLFTGPEHLAKYVDSKADGKTFLTDPEACVRPIYRWFKEYTDPNWVFEDTLASQTMYFPQTDTWINPSIWEKGSFDATTGALVTGQYGFGGWQFGTGLDLSKWKYLVIKLKQTASSGGWSFRVFDENSYWSNCYQKSVGSSLRAIVPLNGMYKTIDGSVSNSSKVNPSHIYIAGFWSYGGTPLYIDKLYLTNQSDYSEEVGLEQVAQDDDVPIVMFDVMGRRVETPHRGGFYMSKDRKFIVR

SEQ ID NO: 46 - DNA, 1839 bp, Artificial sequence
  Synthetic construct
  CDS (1)..(1836)
  sig_peptide (1)..(81)
  mat_peptide (82)..(1836)
atgaagaaaccgttggggaaaattgtcgcaagcaccgcactactcatttctgttgcttttagttcatcgatagcatcagcacatcatcatcaccatcatcctagggagacactctctccattgcatgtggaaggacgttggctttgtaacgaaaacggagaacatgtcaacctgcatggcttcggtcagacgtatagcccttggttcaacgaacagggcaacggttggggctggggctacagcgtcagtgactgtatgaaatacaacaagggactcattgataagattattagcgctggttggaagatgaactggcttcgtctgcacatggatccccattggagcaacactccgggtgtaagtacatcgggcgagaacgacatctcggcttttaatgagtctcgtttccgtacctatctgaacagtctgttcatcccgatggccgaatatgccaatcagcatggcatgtacgttgtgatgcgtccccctggagtctgtccggagaagatagagatcggaggcgcctactacaagtatctgctcaaggtgtggggcattgtggccagcaacgagaagttgaagaacaatcctggcatcatgttcgagttggccaacgagccaatcaacatcaaaggtaccgacggtcagtatacttcgtacagcgacggaagcaaccagaacatgaccaagttctttcaggccatcgtcgatagcatccgttcgtgtggagccaacaacatcctttgggtgccgggtctgggctatcagtcgcaatatgcaggattcgtcaaatatcctatccaaggcgagaatatcggctatgcggtacactgctacccgggctggtatggttccgatagcgaggccgatggtggcagtgtcgaacagggcgtagtcaccaagggagccggttattccgaattcaaggccggctgggataatcaggtgggaccagtcgccaagatcgccccgattctcatcaccgagatggattgggccccgaaatcatataattgttcgtggggtaaggctaccacaggtgtggctggtggcgttggcttcggcgccaacttcaagtacatcgtcgataagaccggcaacgtctcatggatgctcttcaccggaccggaacatctggctaagtatgttgacagcaaagccgatggcaagacctttttgaccgacccggaggcatgtgtccgtccaatctatcgttggttcaaggagtataccgatccgaactgggtcttcgaagatacgttagcgagccaaacgatgtatttcccgcagaccgacacctggatcaatccaagcatttgggagaagggttcgttcgatgccacgacaggagcgctcgtcacgggtcaatatggcttcggcggctggcagttcggtactggattggatctctcgaagtggaaatatctggtcatcaagctcaagcagaccgcatcatcgggcggatggtcgttccgtgtcttcgacgagaacagctattggtccaattgctaccagaagtcggtcggttccagtctgcgtgccatcgttcctttgaatggaatgtataagaccatcgacggttcggtgtcaaattcgtccaaagtcaatccgtcgcatatctatatcgcaggattctggagctatggtggcacaccgctctacatcgacaagctctatctgaccaaccaatcggactattcggaggaggtcggactggaacaagtcgcgcaagacgatgatgttcctatcgttatgttcgatgttatgggtcgtcgcgtagaaacaccgcatcgtggaggcttctacatgagcaaagaccgaaaattcattgtacgttaa

SEQ ID NO: 47 - protein, 612 aa, Artificial sequence
  Synthetic Construct
MKKPLGKIVASTALLISVAFSSSIASAHHHHHHPRETLSPLHVEGRWLCNENGEHVNLHGFGQTYSPWFNEQGNGWGWGYSVSDCMKYNKGLIDKIISAGWKMNWLRLHMDPHWSNTPGVSTSGENDISAFNESRFRTYLNSLFIPMAEYANQHGMYVVMRPPGVCPEKIEIGGAYYKYLLKVWGIVASNEKLKNNPGIMFELANEPINIKGTDGQYTSYSDGSNQNMTKFFQAIVDSIRSCGANNILWVPGLGYQSQYAGFVKYPIQGENIGYAVHCYPGWYGSDSEADGGSVEQGVVTKGAGYSEFKAGWDNQVGPVAKIAPILITEMDWAPKSYNCSWGKATTGVAGGVGFGANFKYIVDKTGNVSWMLFTGPEHLAKYVDSKADGKTFLTDPEACVRPIYRWFKEYTDPNWVFEDTLASQTMYFPQTDTWINPSIWEKGSFDATTGALVTGQYGFGGWQFGTGLDLSKWKYLVIKLKQTASSGGWSFRVFDENSYWSNCYQKSVGSSLRAIVPLNGMYKTIDGSVSNSSKVNPSHIYIAGFWSYGGTPLYIDKLYLTNQSDYSEEVGLEQVAQDDDVPIVMFDVMGRRVETPHRGGFYMSKDRKFIVR

SEQ ID NO: 48 - protein, 585 aa, Artificial sequence
  Synthetic construct
  mat_peptide (1)..(585)
HHHHHHPRETLSPLHVEGRWLCNENGEHVNLHGFGQTYSPWFNEQGNGWGWGYSVSDCMKYNKGLIDKIISAGWKMNWLRLHMDPHWSNTPGVSTSGENDISAFNESRFRTYLNSLFIPMAEYANQHGMYVVMRPPGVCPEKIEIGGAYYKYLLKVWGIVASNEKLKNNPGIMFELANEPINIKGTDGQYTSYSDGSNQNMTKFFQAIVDSIRSCGANNILWVPGLGYQSQYAGFVKYPIQGENIGYAVHCYPGWYGSDSEADGGSVEQGVVTKGAGYSEFKAGWDNQVGPVAKIAPILITEMDWAPKSYNCSWGKATTGVAGGVGFGANFKYIVDKTGNVSWMLFTGPEHLAKYVDSKADGKTFLTDPEACVRPIYRWFKEYTDPNWVFEDTLASQTMYFPQTDTWINPSIWEKGSFDATTGALVTGQYGFGGWQFGTGLDLSKWKYLVIKLKQTASSGGWSFRVFDENSYWSNCYQKSVGSSLRAIVPLNGMYKTIDGSVSNSSKVNPSHIYIAGFWSYGGTPLYIDKLYLTNQSDYSEEVGLEQVAQDDDVPIVMFDVMGRRVETPHRGGFYMSKDRKFIVR

SEQ ID NO: 49 - protein, 384 aa, Aspergillus aculeatus
VGLDQAAVAKGLQYFGTATDNPELTDIPYVTQLNNTADFGQITPGNSMKWDATEPSQGTFTFTKGDVIADLAEGNGQYLRCHTLVWYNQLPSWVTSGTWTNATLTAALKNHITNVVSHYKGKCLHWDVVNEALNDDGTYRTNIFYTTIGEAYIPIAFAAAAAADPDAKLFYNDYNLEYGGAKAASARAIVQLVKNAGAKIDGVGLQAHFSVGTVPSTSSLVSVLQSFTALGVEVAYTEADVRILLPTTATTLAQQSSDFQALVQSCVQTTGCVGFTIWDWTDKYSWVPSTFSGYGAALPWDENLVKKPAYNGLLAGMGVTVTTTTTTTTATATGKTTTTTTGATSTGTTAAHWGQCGGLNWSGPTACATGYTCTYVNDYYSQCL

SEQ ID NO: 50 - protein, 308 aa, Aspergillus aculeatus
NPIEPRQASVSIDAKFKAHGKKYLGTIGDQYTLNKNAKTPAIIKADFGQLTPENSMKWDATEPNRGQFSFSGSDYLVNFAQSNGKLIRGHTLVWHSQLPSWVQSISDKNTLIQVMQNHITTVMQRYKGKVYAWDVVNEIFNEDGSLCQSHFYNVIGEDYVRIAFETARAVDPNAKLYINDYNLDSASYPKLTGLVNHVKKWVAAGVPIDGIGSQTHLSAGAGAAVSGALNALAGAGTKEVAITELDIAGASSTDYVNVVKACLNQPKCVGITVWGSSDPDSWRSSSSPLLFDSNYNPKAAYTAIANAL

SEQ ID NO: 51 - protein, 195 aa, Thermomyces lanuginosus
RQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 52 - protein, 203 aa, Dictyoglomus thermophilum
QTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGS

SEQ ID NO: 53 - protein, 182 aa, Paenibacillus Pabuli
TDYWQNWTDGGGTVNAVNGSGGNYSVNWQNTGNFVVGKGWTYGTPNRVVNYNAGVFSPSGNGYLTFYGWTRNALIEYYVVDNWGTYRPTGTYKGTVTSDGGTYDIYTTMRYNQPSIDGYSTFPQYWSVRQSKRPIGVNSQITFQNHVNAWASKGMYLGNSWSYQVMATEGYQSSGSSNVTVW

SEQ ID NO: 54 - protein, 188 aa, Fusarium oxysporum
TQPTTGTSGGYYFSFWTDTPNSVTYTNGNGGQFSMQWSGNGNHVGGKGWMPGTSRTIKYSGSYNPNGNSYLAVYGWTRNPLIEYYIVENFGTYNPSSGGQKKGEVNVDGSVYDIYVSTRVNAPSIDGNKTFQQYWSVRRNKRSSGSVNTGAHFQAWKNVGLNLGTHDYQILAVEGYYSSGSASMTVSQ

SEQ ID NO: 55 - protein, 189 aa, Aspergillus clavatus
AGTPSSTGWNNGYYYSFWTDNGGTVNYQNGNGGSYSVQWKDTGNFVGGKGWNPGSARTINYSGSFNPSGNAYLTVYGWTTNPLVEYYIVENYGTYNPGNGGTYRGSVYSDGANYNIYTATRYNAPSIEGDKTFTQYWSVRQSKRTGGTVTTANHFNAWAQLGMSLGTHNYQIVATEGYQSSGSSSITVY

SEQ ID NO: 56 - protein, 558 aa, Humicola insolens
MLGLKVLCLSAVVGTAVSVPHAGNLPRQASTFTNPVLWEDHPDLEVFRVGSVFYYSSSTFAYSPGAPVLKSYDLVHWTPVTHSVPRLNFGSNYDLPSGTPGAYVKGIWASTLRYRRSNDRFYWYGCVEGRTYLWTSPGGNALANNGEVPPSAWNWQHTATIDNCYYDAGLLIDDDDTMYIAYGNPTINVAQLSPDGTRQVRVQQRVYAHPQGQTVEGARMYKIRGNYYILVTRPADAEYVLRSTTGSPFGPYEARTLVSRIQGPLANAGFAHQGGIVDAPDGTWHYVAFMDAYPGGRIPVVAPLRWTADGWPEVVTDSQGRWGTSYPIPVRGAKNATEGLASTDLDEFRGTRFSEHWEWNHNPDTSKFTLLGGNEGGLILRTATVTGDLFAARNTLTRRIAGPKASGIFRLDVRGMRDGDRAGAVLFRDRAAYIGVWKQGNEARIVMVDDLRLNEDGWRTASTGRVAANGPVIDTNAQQDIWLRIDADITPAFGTNTERTTTFYYSIDGGRTYTRLGPAFAMTNSWRYFTGYRFGVFNFSTKSLGGEVKVKGFKMNMI

SEQ ID NO: 57 - protein, 643 aa, Meripilus giganteus
MKLLFLLGAFVAQCLAVTVTVNKNPSHTVPSTLYGLMFEDINHSGDGGLYAELLQNRAFQQVTPNTAAALAAWHPISNAKLAVIQDPSPVSNALPNSLQFSVPSGSSGRVGFTNEGFWGIKVDSTWTYKASLFFRFPTSSSFSGALTVGLQTNAGRVLAQNSTQIRGTTTKWTQINLELHPTASAPDVSNSFFVTIDGAAGAGQTINFAMFSLFPPTFKNRPNGLRADIAETLAEMGPSFFRFPGGNNLEGQTTATRWQWNATVGSLLDRPGRVGDWGYVNTDGLGLLEYLQFFEDTGMEPIMAVWAGYSLGGTSLAENQLAPYIQQAIDQINFVIGDPAKSAPAALRASLGHPEPFTLRFVEVGNEDFFAAGSYPYRWHDFVTALQAQFPQIRFIATTNAWNPVLSPVPQSYDVHVYQTPTWFYQNAFYYDGFQRNGTTYFEGEYAAISTNANDLFGTVADGRLAFPTVQSATGEAAFMTGLERNSDIVFAASYAPLLQHVNSTQWTPDLVSYDAGSVIKSTSFFAQKLFALNKGDQYLPSTLPTNGGTLHWSITRASSSGKTFIKIANAGSSAQSLTFQLTQFNSVSSTGTLQVLTGPETASNTPEAPQAIVPKTSTIGTGKTFTYNAPAFSVSVITVTTN

SEQ ID NO: 58 - protein, 327 aa, Thermotoga maritime
QNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIYNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 59 - protein, 8 aa, Artificial sequence
  Synthetic construct
  MISC_FEATURE (2)..(2): The amino acid in position 2 of the conserved motif is phenylalanine (Phe, F) or Tyrosine (Tyr,Y)
  MISC_FEATURE (3)..(3): The amino acid in position 3 of the conserved motif is alanine (Ala, A) or Serine (Ser, S)
  MISC_FEATURE (6)..(6): The amino acid in position 6 of the conserved motif is cysteine (Cys, C), aspartic acid (Asp, D), isoleucine (Ile, I) or tryptophan (Trp, W).
GXXVHXYP

SEQ ID NO: 60 - protein, 8 aa, Artificial sequence
  Synthetic construct
GYAVHWYP

SEQ ID NO: 61 - protein, 9 aa, Artificial sequence
  Synthetic construct
  MISC_FEATURE (1)..(1): The amino acid in position 1 of the conserved motif is isoleucine (Ile, I) or valine (Val, V).
  MISC_FEATURE (2)..(2): The amino acid in position 2 of the conserved motif is histidine (His, H) or methionine (Met, M).
  MISC_FEATURE (3)..(3): The amino acid in position 3 of the conserved motif is phenylalanine (Phe, F) or isoleucine (Ile, I).
  MISC_FEATURE (5)..(5): The amino acid in position 5 of the conserved motif is isoleucine (Ile, I) or leucine (Leu, L).
  MISC_FEATURE (6)..(6): The amino acid in position 6 of the conserved motif is alanine (Ala, A), isoleucine (Ile, I) or valine (Val, V).
XXXEXXNEP

SEQ ID NO: 62 - protein, 9 aa, Artificial sequence
  Synthetic construct
  MISC_FEATURE (5)..(5): The amino acid in position 5 of the conserved motif is isoleucine (Ile, I) or leucine (Leu, L).
  MISC_FEATURE (6)..(6): The amino acid in position 6 of the conserved motif is alanine (Ala, A), isoleucine (Ile, I) or valine (Val, V).
VMFEXXNEP

SEQ ID NO: 63 - protein, 11 aa, Artificial sequence
  Synthetic construct
  MISC_FEATURE (2)..(2): The amino acid in position 2 of the conserved motif is alanine (Ala, A) or tryptophan (Trp, W).
  MISC_FEATURE (3)..(3): The amino acid in position 3 of the conserved motif is lysine (Lys, K), asparagine (Asn, N) or tyrosine (Tyr, Y).
  MISC_FEATURE (4)..(4): The amino acid in position 4 of the conserved motif is cysteine (Cys, C), lysine (Lys, K), methionine (Met, M), serine (Ser, S) or valine (Val, V).
  MISC_FEATURE (6)..(6): The amino acid in position 6 of the conserved motif is leucine (Leu, L), glutamine (Glu, Q), tryptophan (Trp, W) or tyrosine (Tyr, Y).
  MISC_FEATURE (7)..(7): The amino acid in position 4 of the conserved motif is phenylalanine (Phe, F), isoleucine (Ile, I), leucine (Leu, L) or valine (Val, V).
  MISC_FEATURE (10)..(10): The amino acid in position 10 of the conserved motif is phenylalanine (Phe, F) or histidine (His, H).
  MISC_FEATURE (11)..(11): The amino acid in position 11 of the conserved motif is isoleucine (Ile, I), leucine (Leu, L) or methionine (Met, M).
GXXXNXXRLXX

SEQ ID NO: 64 - protein, 11 aa, Artificial sequence
  Synthetic construct
GWNMNQVRLFI

SEQ ID NO: 65 - DNA, 1704 bp, Paenibacillus campinasensis
  CDS (1)..(1701)
  sig_peptide (1)..(90)
  mat_peptide (91)..(1701)
atgaaaagaactggatggacgcttaagttgttattggctgtgctgctcctgctgccgataacgctggggcaccctaacggtgctgctgacgcatggtcgggcatgccgatgtccaagcttcgcgtcagcggcaatcagctggtaaacagcgaggggcagcccgttgtcctcagcggatggcaccagcctgggggctcgtactggacgtatcagggaagcaactactacctgaaccggaatggaggaaatcgccatgctgccattttggaatatctaaaggatattaccgacacattctccgatacgtctccgaagtacggcaacaatcacggctggtatatgaatcaggtcaggctctttatcgaccgcgaagacatgggcgacgtggcggccggaacgtataattttgcgggcgtgcagtcctttacgcagaatgttgtcgtgccttatatccagtatgctaagagcaagggaatctacgttacgctaggcctcgacttcacgctccaggataatcaggcaacgacgcaagccaatctcgagaaattcaatcaaatctggggatatcttgcggcacaacctgcgatcaaaagcgcggacaacgtcatgttcgagattatcaatgagccggtgctgtcctatgcgaatggacgctggggaggacacccgtctgatcccgattttccggcgttttgggactcgcttcgcaattttcaaaattccatcatttccacgatccgcagtcaaggggcagataacgtgatatgggctgccggccttggatgggatcaatattatcagttatgcgccacgcgtccgctaaccgatccgctgaacaacatcggatatgccgtgcattggtacccgggctacggagcaaaggataacggttcgatactccagcagcagtgggataccaacattaagccttgcgcggacaactatccgatcaatattacggaaacgacctggttcaaacggttgccgggagactcggagtactgggagctgttcaacggctcgaacgaaggcttcggcaaaaacaccaaagcgatatttacgacagccgggaacgtcagcatcgcggtccacatgaacggttttcttctgcagccggggccaagaagcacgtttgccgatccgacgtcaggtctgctcttcgacggcgatccggcacgggacggcatggcccgctttatcttcgaatggtattacgaacgtgcgcagcttcatccatggaacggcatatggaatggtattatatcgggagaaacctataaaatcgtgaaccgtgcctcagggaaggtgatcgacgtcccgggcggacaaaacagcaattcgctgcagctgcagcaatggccggacaataacgccacggcgcagcgatgggttgcggacgatatgggagcatacaacaatgtataccggcttcgcagcgtcagttcgagcgacggcaaggtgatggatgttagaaacggttcttcaaacaacggggaagcaatacagctcatgcaggattatgggaatcaagcgcagcgattccgtctgatcaagctcagcaacggatactggagcatccttaacgccaacagcaataaagccgtcgaagtggcgggtggttcgtccgcagacggagccaagctccagcagaatccttatcgaggggatttgcatcagcaatggcagctggtcaaggtgaattaa

SEQ ID NO: 66 - protein, 567 aa, Paenibacillus campinasensis
MKRTGWTLKLLLAVLLLLPITLGHPNGAADAWSGMPMSKLRVSGNQLVNSEGQPVVLSGWHQPGGSYWTYQGSNYYLNRNGGNRHAAILEYLKDITDTFSDTSPKYGNNHGWYMNQVRLFIDREDMGDVAAGTYNFAGVQSFTQNVVVPYIQYAKSKGIYVTLGLDFTLQDNQATTQANLEKFNQIWGYLAAQPAIKSADNVMFEIINEPVLSYANGRWGGHPSDPDFPAFWDSLRNFQNSIISTIRSQGADNVIWAAGLGWDQYYQLCATRPLTDPLNNIGYAVHWYPGYGAKDNGSILQQQWDTNIKPCADNYPINITETTWFKRLPGDSEYWELFNGSNEGFGKNTKAIFTTAGNVSIAVHMNGFLLQPGPRSTFADPTSGLLFDGDPARDGMARFIFEWYYERAQLHPWNGIWNGIISGETYKIVNRASGKVIDVPGGQNSNSLQLQQWPDNNATAQRWVADDMGAYNNVYRLRSVSSSDGKVMDVRNGSSNNGEAIQLMQDYGNQAQRFRLIKLSNGYWSILNANSNKAVEVAGGSSADGAKLQQNPYRGDLHQQWQLVKVN

SEQ ID NO: 67 - protein, 537 aa, Paenibacillus campinasensis
  mat_peptide (1)..(537)
AWSGMPMSKLRVSGNQLVNSEGQPVVLSGWHQPGGSYWTYQGSNYYLNRNGGNRHAAILEYLKDITDTFSDTSPKYGNNHGWYMNQVRLFIDREDMGDVAAGTYNFAGVQSFTQNVVVPYIQYAKSKGIYVTLGLDFTLQDNQATTQANLEKFNQIWGYLAAQPAIKSADNVMFEIINEPVLSYANGRWGGHPSDPDFPAFWDSLRNFQNSIISTIRSQGADNVIWAAGLGWDQYYQLCATRPLTDPLNNIGYAVHWYPGYGAKDNGSILQQQWDTNIKPCADNYPINITETTWFKRLPGDSEYWELFNGSNEGFGKNTKAIFTTAGNVSIAVHMNGFLLQPGPRSTFADPTSGLLFDGDPARDGMARFIFEWYYERAQLHPWNGIWNGIISGETYKIVNRASGKVIDVPGGQNSNSLQLQQWPDNNATAQRWVADDMGAYNNVYRLRSVSSSDGKVMDVRNGSSNNGEAIQLMQDYGNQAQRFRLIKLSNGYWSILNANSNKAVEVAGGSSADGAKLQQNPYRGDLHQQWQLVKVN

SEQ ID NO: 68 - DNA, 1719 bp, Artificial sequence
  Synthetic construct
  CDS (1)..(1716)
  sig_peptide (1)..(81)
  mat_peptide (82)..(1716)
atgaagaaaccgttggggaaaattgtcgcaagcaccgcactactcatttctgttgcttttagttcatcgatagcatcagcacatcatcatcaccatcatcctagggcatggtcgggcatgccgatgtccaagcttcgcgtcagcggcaatcagctggtaaacagcgaggggcagcccgttgtcctcagcggatggcaccagcctgggggctcgtactggacgtatcagggaagcaactactacctgaaccggaatggaggaaatcgccatgctgccattttggaatatctaaaggatattaccgacacattctccgatacgtctccgaagtacggcaacaatcacggctggtatatgaatcaggtcaggctctttatcgaccgcgaagacatgggcgacgtggcggccggaacgtataattttgcgggcgtgcagtcctttacgcagaatgttgtcgtgccttatatccagtatgctaagagcaagggaatctacgttacgctaggcctcgacttcacgctccaggataatcaggcaacgacgcaagccaatctcgagaaattcaatcaaatctggggatatcttgcggcacaacctgcgatcaaaagcgcggacaacgtcatgttcgagattatcaatgagccggtgctgtcctatgcgaatggacgctggggaggacacccgtctgatcccgattttccggcgttttgggactcgcttcgcaattttcaaaattccatcatttccacgatccgcagtcaaggggcagataacgtgatatgggctgccggccttggatgggatcaatattatcagttatgcgccacgcgtccgctaaccgatccgctgaacaacatcggatatgccgtgcattggtacccgggctacggagcaaaggataacggttcgatactccagcagcagtgggataccaacattaagccttgcgcggacaactatccgatcaatattacggaaacgacctggttcaaacggttgccgggagactcggagtactgggagctgttcaacggctcgaacgaaggcttcggcaaaaacaccaaagcgatatttacgacagccgggaacgtcagcatcgcggtccacatgaacggttttcttctgcagccggggccaagaagcacgtttgccgatccgacgtcaggtctgctcttcgacggcgatccggcacgggacggcatggcccgctttatcttcgaatggtattacgaacgtgcgcagcttcatccatggaacggcatatggaatggtattatatcgggagaaacctataaaatcgtgaaccgtgcctcagggaaggtgatcgacgtcccgggcggacaaaacagcaattcgctgcagctgcagcaatggccggacaataacgccacggcgcagcgatgggttgcggacgatatgggagcatacaacaatgtataccggcttcgcagcgtcagttcgagcgacggcaaggtgatggatgttagaaacggttcttcaaacaacggggaagcaatacagctcatgcaggattatgggaatcaagcgcagcgattccgtctgatcaagctcagcaacggatactggagcatccttaacgccaacagcaataaagccgtcgaagtggcgggtggttcgtccgcagacggagccaagctccagcagaatccttatcgaggggatttgcatcagcaatggcagctggtcaaggtgaattaa

SEQ ID NO: 69 - protein, 572 aa, Artificial sequence
  Synthetic Construct
MKKPLGKIVASTALLISVAFSSSIASAHHHHHHPRAWSGMPMSKLRVSGNQLVNSEGQPVVLSGWHQPGGSYWTYQGSNYYLNRNGGNRHAAILEYLKDITDTFSDTSPKYGNNHGWYMNQVRLFIDREDMGDVAAGTYNFAGVQSFTQNVVVPYIQYAKSKGIYVTLGLDFTLQDNQATTQANLEKFNQIWGYLAAQPAIKSADNVMFEIINEPVLSYANGRWGGHPSDPDFPAFWDSLRNFQNSIISTIRSQGADNVIWAAGLGWDQYYQLCATRPLTDPLNNIGYAVHWYPGYGAKDNGSILQQQWDTNIKPCADNYPINITETTWFKRLPGDSEYWELFNGSNEGFGKNTKAIFTTAGNVSIAVHMNGFLLQPGPRSTFADPTSGLLFDGDPARDGMARFIFEWYYERAQLHPWNGIWNGIISGETYKIVNRASGKVIDVPGGQNSNSLQLQQWPDNNATAQRWVADDMGAYNNVYRLRSVSSSDGKVMDVRNGSSNNGEAIQLMQDYGNQAQRFRLIKLSNGYWSILNANSNKAVEVAGGSSADGAKLQQNPYRGDLHQQWQLVKVN

SEQ ID NO: 70 - protein, 545 aa, Artificial sequence
  Synthetic construct
  mat_peptide (1)..(545)
HHHHHHPRAWSGMPMSKLRVSGNQLVNSEGQPVVLSGWHQPGGSYWTYQGSNYYLNRNGGNRHAAILEYLKDITDTFSDTSPKYGNNHGWYMNQVRLFIDREDMGDVAAGTYNFAGVQSFTQNVVVPYIQYAKSKGIYVTLGLDFTLQDNQATTQANLEKFNQIWGYLAAQPAIKSADNVMFEIINEPVLSYANGRWGGHPSDPDFPAFWDSLRNFQNSIISTIRSQGADNVIWAAGLGWDQYYQLCATRPLTDPLNNIGYAVHWYPGYGAKDNGSILQQQWDTNIKPCADNYPINITETTWFKRLPGDSEYWELFNGSNEGFGKNTKAIFTTAGNVSIAVHMNGFLLQPGPRSTFADPTSGLLFDGDPARDGMARFIFEWYYERAQLHPWNGIWNGIISGETYKIVNRASGKVIDVPGGQNSNSLQLQQWPDNNATAQRWVADDMGAYNNVYRLRSVSSSDGKVMDVRNGSSNNGEAIQLMQDYGNQAQRFRLIKLSNGYWSILNANSNKAVEVAGGSSADGAKLQQNPYRGDLHQQWQLVKVN

SEQ ID NO: 71 - DNA, 1707 bp, Paenibacillus species
  CDS (1)..(1704)
  sig_peptide (1)..(96)
  mat_peptide (97)..(1704)
gtgagaaaaaggaagttgaactggtccatcaagctgctggttatgatggcgttgctgctggttcctatgcagaccggcggcggtaccgcaagtgcctgggagggaactcccgtgtccaagctccatgtcagcggcaaccagctggtgaacggcagcggacagcctgtactcctcagcggctggcatcagcctaccggagcctactggacgtatcagaacagcaattattatctgaaccgcaacgcagggaaccgacataaggccactctggagtaccttaaggaaattacggacaccttcaccagcacctcgggcaaatacggcaacagccatggctggtactcgaaccaggtccgtctgttcatcgaccgggaggatatgggggatgtggcagcaggaacctataacttcgcgggtcttcaggcggctacccagaatgtgattatcccttatgtccaatatgccaagacgaaagggctgtatgtcacactggggctggatttcaccctgctggacaacaaggcgaccacccaggccaatctggacaagttcaatcagatctggggttacctggcctcccagccggccctcaagagcgcggataatgtcatgttcgagctggttaacgagccggtgctgagcgatgtgaacggacaatggggcggtaatccctctcagcctaacttcgcggcgttctggaattctctgaaaaacttccagaactctatgatctccacgatccgcagcaagggcgcggataatgtgatctgggctgcgggactcggatgggatcagcattaccagctgaccgcatcgaatccgcttacggaccctctgaacaactacggctatgccgtacactggtatccgggctacggcgcgtatgacaatttcaattcgcttcagcagatctgggatagcagcatcaagcctgctgccgataagtacccgatcaatattaccgagacgacctggttcaaaagacagccgggagactccgaatattgggatctgttcaacggtacgaacgcaggcttcggcaagaacaccaaagcgatctttaccgcagccggtaatgtcagcattgccgtccatatgaacggcttcctgctggaccccggtcccaaaagctccttcgcagaccctgacggcggactgatgtatgacggcaatgccacccgggacggaatggcgcggtttatcttcgaatggtactatgagcgggcgcagttcaatccctggaacggcgtatggaacggggtaaccaacaatgcgaagtataagctgatcaaccgggcgtcaggcaaagcgattgacgttccgaacgggcagaatacgaactcccttcagcttcagcaatggccggagaacactgcggctgcccagcaatggacagctaccgatatgggcacctacaataacgtgtaccggctgcgcagtgtgaactcttcggacaacaaagtaatggatgtgcgaaacggaacgaagaataacggcgaagccatccagctcatgcaggatttgaacaacactgcccagcagttcagactgattaagctgagtaacgggtactggagcattctcaacgtgaacagcaacagagccgttgaagtcacaggagcctccacagccgacggtgcgaagctgcagcagaaccagtaccgcggcgatctgcaccagcaatggaagctggttcaggtgaattaa

SEQ ID NO: 72 - protein, 568 aa, Paenibacillus species
VRKRKLNWSIKLLVMMALLLVPMQTGGGTASAWEGTPVSKLHVSGNQLVNGSGQPVLLSGWHQPTGAYWTYQNSNYYLNRNAGNRHKATLEYLKEITDTFTSTSGKYGNSHGWYSNQVRLFIDREDMGDVAAGTYNFAGLQAATQNVIIPYVQYAKTKGLYVTLGLDFTLLDNKATTQANLDKFNQIWGYLASQPALKSADNVMFELVNEPVLSDVNGQWGGNPSQPNFAAFWNSLKNFQNSMISTIRSKGADNVIWAAGLGWDQHYQLTASNPLTDPLNNYGYAVHWYPGYGAYDNFNSLQQIWDSSIKPAADKYPINITETTWFKRQPGDSEYWDLFNGTNAGFGKNTKAIFTAAGNVSIAVHMNGFLLDPGPKSSFADPDGGLMYDGNATRDGMARFIFEWYYERAQFNPWNGVWNGVTNNAKYKLINRASGKAIDVPNGQNTNSLQLQQWPENTAAAQQWTATDMGTYNNVYRLRSVNSSDNKVMDVRNGTKNNGEAIQLMQDLNNTAQQFRLIKLSNGYWSILNVNSNRAVEVTGASTADGAKLQQNQYRGDLHQQWKLVQVN

SEQ ID NO: 73 - protein, 536 aa, Paenibacillus species
  mat_peptide (1)..(536)
WEGTPVSKLHVSGNQLVNGSGQPVLLSGWHQPTGAYWTYQNSNYYLNRNAGNRHKATLEYLKEITDTFTSTSGKYGNSHGWYSNQVRLFIDREDMGDVAAGTYNFAGLQAATQNVIIPYVQYAKTKGLYVTLGLDFTLLDNKATTQANLDKFNQIWGYLASQPALKSADNVMFELVNEPVLSDVNGQWGGNPSQPNFAAFWNSLKNFQNSMISTIRSKGADNVIWAAGLGWDQHYQLTASNPLTDPLNNYGYAVHWYPGYGAYDNFNSLQQIWDSSIKPAADKYPINITETTWFKRQPGDSEYWDLFNGTNAGFGKNTKAIFTAAGNVSIAVHMNGFLLDPGPKSSFADPDGGLMYDGNATRDGMARFIFEWYYERAQFNPWNGVWNGVTNNAKYKLINRASGKAIDVPNGQNTNSLQLQQWPENTAAAQQWTATDMGTYNNVYRLRSVNSSDNKVMDVRNGTKNNGEAIQLMQDLNNTAQQFRLIKLSNGYWSILNVNSNRAVEVTGASTADGAKLQQNQYRGDLHQQWKLVQVN

SEQ ID NO: 74 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtgggagggaactcccgtgtccaagctccatgtcagcggcaaccagctggtgaacggcagcggacagcctgtactcctcagcggctggcatcagcctaccggagcctactggacgtatcagaacagcaattattatctgaaccgcaacgcagggaaccgacataaggccactctggagtaccttaaggaaattacggacaccttcaccagcacctcgggcaaatacggcaacagccatggctggtactcgaaccaggtccgtctgttcatcgaccgggaggatatgggggatgtggcagcaggaacctataacttcgcgggtcttcaggcggctacccagaatgtgattatcccttatgtccaatatgccaagacgaaagggctgtatgtcacactggggctggatttcaccctgctggacaacaaggcgaccacccaggccaatctggacaagttcaatcagatctggggttacctggcctcccagccggccctcaagagcgcggataatgtcatgttcgagctggttaacgagccggtgctgagcgatgtgaacggacaatggggcggtaatccctctcagcctaacttcgcggcgttctggaattctctgaaaaacttccagaactctatgatctccacgatccgcagcaagggcgcggataatgtgatctgggctgcgggactcggatgggatcagcattaccagctgaccgcatcgaatccgcttacggaccctctgaacaactacggctatgccgtacactggtatccgggctacggcgcgtatgacaatttcaattcgcttcagcagatctgggatagcagcatcaagcctgctgccgataagtacccgatcaatattaccgagacgacctggttcaaaagacagccgggagactccgaatattgggatctgttcaacggtacgaacgcaggcttcggcaagaacaccaaagcgatctttaccgcagccggtaatgtcagcattgccgtccatatgaacggcttcctgctggaccccggtcccaaaagctccttcgcagaccctgacggcggactgatgtatgacggcaatgccacccgggacggaatggcgcggtttatcttcgaatggtactatgagcgggcgcagttcaatccctggaacggcgtatggaacggggtaaccaacaatgcgaagtataagctgatcaaccgggcgtcaggcaaagcgattgacgttccgaacgggcagaatacgaactcccttcagcttcagcaatggccggagaacactgcggctgcccagcaatggacagctaccgatatgggcacctacaataacgtgtaccggctgcgcagtgtgaactcttcggacaacaaagtaatggatgtgcgaaacggaacgaagaataacggcgaagccatccagctcatgcaggatttgaacaacactgcccagcagttcagactgattaagctgagtaacgggtactggagcattctcaacgtgaacagcaacagagccgttgaagtcacaggagcctccacagccgacggtgcgaagctgcagcagaaccagtaccgcggcgatctgcaccagcaatggaagctggttcaggtgaattaa

SEQ ID NO: 75 - protein, 571 aa, Artificial sequence
  Synthetic Construct
MKKPLGKIVASTALLISVAFSSSIASAHHHHHHPRWEGTPVSKLHVSGNQLVNGSGQPVLLSGWHQPTGAYWTYQNSNYYLNRNAGNRHKATLEYLKEITDTFTSTSGKYGNSHGWYSNQVRLFIDREDMGDVAAGTYNFAGLQAATQNVIIPYVQYAKTKGLYVTLGLDFTLLDNKATTQANLDKFNQIWGYLASQPALKSADNVMFELVNEPVLSDVNGQWGGNPSQPNFAAFWNSLKNFQNSMISTIRSKGADNVIWAAGLGWDQHYQLTASNPLTDPLNNYGYAVHWYPGYGAYDNFNSLQQIWDSSIKPAADKYPINITETTWFKRQPGDSEYWDLFNGTNAGFGKNTKAIFTAAGNVSIAVHMNGFLLDPGPKSSFADPDGGLMYDGNATRDGMARFIFEWYYERAQFNPWNGVWNGVTNNAKYKLINRASGKAIDVPNGQNTNSLQLQQWPENTAAAQQWTATDMGTYNNVYRLRSVNSSDNKVMDVRNGTKNNGEAIQLMQDLNNTAQQFRLIKLSNGYWSILNVNSNRAVEVTGASTADGAKLQQNQYRGDLHQQWKLVQVN

SEQ ID NO: 76 - protein, 544 aa, Artificial sequence
  Synthetic construct
  mat_peptide (1)..(544)
HHHHHHPRWEGTPVSKLHVSGNQLVNGSGQPVLLSGWHQPTGAYWTYQNSNYYLNRNAGNRHKATLEYLKEITDTFTSTSGKYGNSHGWYSNQVRLFIDREDMGDVAAGTYNFAGLQAATQNVIIPYVQYAKTKGLYVTLGLDFTLLDNKATTQANLDKFNQIWGYLASQPALKSADNVMFELVNEPVLSDVNGQWGGNPSQPNFAAFWNSLKNFQNSMISTIRSKGADNVIWAAGLGWDQHYQLTASNPLTDPLNNYGYAVHWYPGYGAYDNFNSLQQIWDSSIKPAADKYPINITETTWFKRQPGDSEYWDLFNGTNAGFGKNTKAIFTAAGNVSIAVHMNGFLLDPGPKSSFADPDGGLMYDGNATRDGMARFIFEWYYERAQFNPWNGVWNGVTNNAKYKLINRASGKAIDVPNGQNTNSLQLQQWPENTAAAQQWTATDMGTYNNVYRLRSVNSSDNKVMDVRNGTKNNGEAIQLMQDLNNTAQQFRLIKLSNGYWSILNVNSNRAVEVTGASTADGAKLQQNQYRGDLHQQWKLVQVN

SEQ ID NO: 77 - DNA, 1698 bp, Paenibacillus favisporus
  CDS (1)..(1695)
  sig_peptide (1)..(87)
  mat_peptide (88)..(1695)
gtgaagaaaatgagatggaccatcaagttactactggccctattgctcgtaatcccgacgctcatgaacagccaccgcgcggatgcatggaacggaatgcccatgtccaagctccatgtgagcggcaaccagctggtgaacagcagcgggcagcccgtcctgctaagcggttggcatcagccctcgggctcctattggacctaccagtccagcagctactatctggaccggaacggagggaaccggcatgcggcaattctggactatttgaaggttatcaccgatacctttaccggtacctctgccaagtacggcagcagccacggctggtatatgaatcaggtccggctgtttatcgaccgggaggatatgggcgacgtagccgccgggacgtataattttgccggtttgcagagcgttacgcaggacgtcatcattccgtatattgcctatgccaagaccaagggcctgtatgtcacgctgggtctcgattttaccctttcaaacaaccaggcaaccaccccatccaatctgaacaagttcaacgaaatctggggttaccttgcctcccaaccggcgatcaagagcgcggacaacgtgatgttcgaactgatcaatgaaccggtcctgtccgatgtcaacgggcaatggggcggaaatccctctcaacccaatttcgctgactactggaactcccttaaaaaatttcaaaactccatcatatccacgatacgcagtaaaggtgccgacaacgtgatatgggccgcggggcttggctgggatcaatactaccagctctgtgcatccagtccgctgacggatcccttgaacaatatcgggtattccgttcactggtacccagggtacggtgcccatgacgattatgcgactctgcagcagcagtgggatacgaatattaagccctgcgccgatcattatcccatcaacattacggagaccacctggttcaagacacagcccggggattcttcctactgggagctgttcaacgggtccaatgaaggtttcgggaaaaacacgaaggctattttcacagcggctggcaatgtcagcatgaccgcgcatatgaacggatttttgctggagcccggcacaagaagttctttcgccgatccaaccgcaggcctcaaatatgacggcaataccgcacgggacggcatggcccgtttcctcttcgaatggtattacgaacgcgcgcagttgaacccttggaacggtatatggaacggagtcctgtccggctcgacgtataagatcgtgaaccgcgcatcgggtaaagcgattgacgtgccgggcggtcagaataccaacgggctgcagcttcagcagtggtcagacaacaatgcaacagcccagcaatgggttgctgatgatctggggacttacaacaacgtgtacaggctgcgaagcgtcagctcggccgaccaaaaagtcatggatatccgaaacggaacgaaaaacaacggcgaagcggtccaactcatgcaggacttgggaaataccgcacagcagttcagattgatcaaactgagcaacggttactggagcatcctcaatgtaaacagcaacaaggccgtcgaggttgccggagcctcctcagcggacggagcgaagcttcagcaaaatctctaccggggtgatctgaaccagcaatggcagctggtgaaaatcaattag

SEQ ID NO: 78 - protein, 565 aa, Paenibacillus favisporus
VKKMRWTIKLLLALLLVIPTLMNSHRADAWNGMPMSKLHVSGNQLVNSSGQPVLLSGWHQPSGSYWTYQSSSYYLDRNGGNRHAAILDYLKVITDTFTGTSAKYGSSHGWYMNQVRLFIDREDMGDVAAGTYNFAGLQSVTQDVIIPYIAYAKTKGLYVTLGLDFTLSNNQATTPSNLNKFNEIWGYLASQPAIKSADNVMFELINEPVLSDVNGQWGGNPSQPNFADYWNSLKKFQNSIISTIRSKGADNVIWAAGLGWDQYYQLCASSPLTDPLNNIGYSVHWYPGYGAHDDYATLQQQWDTNIKPCADHYPINITETTWFKTQPGDSSYWELFNGSNEGFGKNTKAIFTAAGNVSMTAHMNGFLLEPGTRSSFADPTAGLKYDGNTARDGMARFLFEWYYERAQLNPWNGIWNGVLSGSTYKIVNRASGKAIDVPGGQNTNGLQLQQWSDNNATAQQWVADDLGTYNNVYRLRSVSSADQKVMDIRNGTKNNGEAVQLMQDLGNTAQQFRLIKLSNGYWSILNVNSNKAVEVAGASSADGAKLQQNLYRGDLNQQWQLVKIN

SEQ ID NO: 79 - protein, 536 aa, Paenibacillus favisporus
  mat_peptide (1)..(536)
WNGMPMSKLHVSGNQLVNSSGQPVLLSGWHQPSGSYWTYQSSSYYLDRNGGNRHAAILDYLKVITDTFTGTSAKYGSSHGWYMNQVRLFIDREDMGDVAAGTYNFAGLQSVTQDVIIPYIAYAKTKGLYVTLGLDFTLSNNQATTPSNLNKFNEIWGYLASQPAIKSADNVMFELINEPVLSDVNGQWGGNPSQPNFADYWNSLKKFQNSIISTIRSKGADNVIWAAGLGWDQYYQLCASSPLTDPLNNIGYSVHWYPGYGAHDDYATLQQQWDTNIKPCADHYPINITETTWFKTQPGDSSYWELFNGSNEGFGKNTKAIFTAAGNVSMTAHMNGFLLEPGTRSSFADPTAGLKYDGNTARDGMARFLFEWYYERAQLNPWNGIWNGVLSGSTYKIVNRASGKAIDVPGGQNTNGLQLQQWSDNNATAQQWVADDLGTYNNVYRLRSVSSADQKVMDIRNGTKNNGEAVQLMQDLGNTAQQFRLIKLSNGYWSILNVNSNKAVEVAGASSADGAKLQQNLYRGDLNQQWQLVKIN

SEQ ID NO: 80 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtggaatggcatgccgatgtcaaaactgcatgtttcaggcaatcaactggttaattcatcaggccaaccggttctgctgtcaggctggcatcaaccgtcaggctcatattggacatatcaatcatcaagctattatctggatcgcaatggcggaaatagacatgcagcaattctggattatctgaaagtcatcacagatacatttacaggcacaagcgcaaaatatggctcatcacatggctggtatatgaatcaagtccgcctgtttattgatcgcgaagatatgggagatgttgcagcaggcacatataactttgcaggccttcaatcagttacacaggatgttattattccgtatatcgcgtatgcgaaaacgaaaggcctgtatgttacactgggcctggattttacacttagcaataatcaagcaacaacaccgagcaacctgaacaaatttaacgaaatttggggctatctggcatcacaaccggcaattaaatcagcagataacgtcatgtttgaactgattaatgaaccggtcctgtcagatgttaatggccaatggggaggcaatccgtcacaaccgaattttgcagattattggaacagcctgaaaaaatttcagaacagcatcattagcacgattagatcaaaaggcgcagataatgttatttgggcagcaggcctgggctgggatcaatattatcaactgtgcgcatcatcaccgctgacagatccgctgaataacattggctattcagttcattggtatccgggatatggcgcacatgatgattatgcaacactgcaacaacaatgggacacaaacattaaaccgtgcgcagatcattatccgatcaacattacagaaacgacgtggtttaaaacacaacctggcgattcatcatactgggaactgtttaatggcagcaatgaaggctttggcaaaaacacaaaagcgatttttacagcggcaggcaatgtttcaatgacagcacatatgaatggctttctgctggaaccgggaacaagatcatcatttgcagatccgacagcaggactgaaatatgatggcaatacagcaagagatggcatggcaagatttctgtttgaatggtattatgaacgcgcacaactgaatccgtggaatggaatttggaatggcgttctttcaggcagcacatacaaaattgttaatagagcaagcggcaaagcgattgatgttcctggcggacaaaatacaaatggcctgcaacttcaacagtggtcagataataatgcaacagcacaacagtgggttgcagatgatctgggaacatataacaatgtttatagactgagaagcgtcagctcagcagatcaaaaagttatggatattcgcaacggcacaaaaaacaatggcgaagcagttcaactgatgcaagatctgggcaacacagcgcaacaatttagactgattaaactgagcaatggctattggagcattctgaatgtcaatagcaataaagcagtcgaagtcgcaggcgcatcaagcgcagatggcgcaaaacttcagcaaaatctgtatagaggcgatctgaatcaacaatggcaactggtcaaaatcaactaa

SEQ ID NO: 81 - protein, 571 aa, Artificial sequence
  Synthetic Construct
MKKPLGKIVASTALLISVAFSSSIASAHHHHHHPRWNGMPMSKLHVSGNQLVNSSGQPVLLSGWHQPSGSYWTYQSSSYYLDRNGGNRHAAILDYLKVITDTFTGTSAKYGSSHGWYMNQVRLFIDREDMGDVAAGTYNFAGLQSVTQDVIIPYIAYAKTKGLYVTLGLDFTLSNNQATTPSNLNKFNEIWGYLASQPAIKSADNVMFELINEPVLSDVNGQWGGNPSQPNFADYWNSLKKFQNSIISTIRSKGADNVIWAAGLGWDQYYQLCASSPLTDPLNNIGYSVHWYPGYGAHDDYATLQQQWDTNIKPCADHYPINITETTWFKTQPGDSSYWELFNGSNEGFGKNTKAIFTAAGNVSMTAHMNGFLLEPGTRSSFADPTAGLKYDGNTARDGMARFLFEWYYERAQLNPWNGIWNGVLSGSTYKIVNRASGKAIDVPGGQNTNGLQLQQWSDNNATAQQWVADDLGTYNNVYRLRSVSSADQKVMDIRNGTKNNGEAVQLMQDLGNTAQQFRLIKLSNGYWSILNVNSNKAVEVAGASSADGAKLQQNLYRGDLNQQWQLVKIN

SEQ ID NO: 82 - protein, 544 aa, Artificial sequence
  Synthetic construct
  mat_peptide (1)..(544)
HHHHHHPRWNGMPMSKLHVSGNQLVNSSGQPVLLSGWHQPSGSYWTYQSSSYYLDRNGGNRHAAILDYLKVITDTFTGTSAKYGSSHGWYMNQVRLFIDREDMGDVAAGTYNFAGLQSVTQDVIIPYIAYAKTKGLYVTLGLDFTLSNNQATTPSNLNKFNEIWGYLASQPAIKSADNVMFELINEPVLSDVNGQWGGNPSQPNFADYWNSLKKFQNSIISTIRSKGADNVIWAAGLGWDQYYQLCASSPLTDPLNNIGYSVHWYPGYGAHDDYATLQQQWDTNIKPCADHYPINITETTWFKTQPGDSSYWELFNGSNEGFGKNTKAIFTAAGNVSMTAHMNGFLLEPGTRSSFADPTAGLKYDGNTARDGMARFLFEWYYERAQLNPWNGIWNGVLSGSTYKIVNRASGKAIDVPGGQNTNGLQLQQWSDNNATAQQWVADDLGTYNNVYRLRSVSSADQKVMDIRNGTKNNGEAVQLMQDLGNTAQQFRLIKLSNGYWSILNVNSNKAVEVAGASSADGAKLQQNLYRGDLNQQWQLVKIN

SEQ ID NO: 83 - DNA, 1701 bp, Paenibacillus tundra
  CDS (1)..(1698)
  sig_peptide (1)..(93)
  mat_peptide (94)..(1698)
atgttgaagaagatgttgaattactgtaaatttatgctcattctggctttgctgctgtccatcacgccactcggatcgggtcgcgcggacgcgtgggttggcatgcctatgggcaagcttcacgtcagtgggaaaaatctagtgaacagcagtaaccaacccgtcgtaatgagtggctggcatcagccctcaggagcctactggacctaccagaacagcaactattatctcactcgaaacggcaacaaccgccatgccgctacattggcttatctgaaagacattaccgatacatttacaagtacaagtcctaaatacggaagcagccacggctggaatatgaatcagattcgtctgttcattgaccgcgaggacatgggagacgtagcagcaggcacttataattttgctggtatacaaactgtaacgcagaacgtcattatcccttatatccaatatgcaaaaacgaaaggcgtctatgttacactcggacttgacttcacattgaaggatgatcaagctacgaccgcagccaatctgcaaaagttcaatcaaatctggggttatctcgcttctcgcccggaaattaaaagcgcagacaacgtacactttgagctaatcaatgagccggttaaatcgtatgctaacggacattggggcggctacaacggcgagaacgactttgtggatcactggaatgatctgcgcaatttccagaactccatcatctcaaccatccgcagccaaggcgcggataatgttatctgggccgctggtttggggtacaaccaattctatagtctgacagcaagccatcccttaacagaccctttgaacaattacggttatgccgttcactggtatccggggtacggagcgcatgacaacatgtcgattctgcaagatcagtggaatacgaatgtgaaggctgcggctgataaatatccgattaacatcaccgaagtcacgtggttcaaaacgaagccgggcgattccgaatactggaatctgttcaacggcagtaatgaaggttttggcaacaatacgaagaccattttcaacgcggcaggcaatgtcagcattgcagcacatatgaacggcttcattttggatgccggggaacgaagctcctttgccgatccgacggcaggcctgaaatgggacggtgatgcttcacggagcgcgatgggacgttttctgttcgattggttctatgaacgcgcacagtcttacccgaacggtggcactccatcaacgggattgacgccgggggcaacctacaagatcgtggctagacattcgggcaaagttatagatgtaccgggtggggtaaatgagagcaatttgcagcttcagcaatggtctgatctgggcggcaatcctcaaaagtgggtcctgacccagattgctagtggaatttacagtttgacgagtgtaaattcgcccgataaggtcatcgacattcgtaatgggacaagtaacaacggagaggcagtacaactcatgagcaatttgaataccaccgcgcagcattttaaaatcaacgatctgggcaatggctattggagtattataaacgtcaacagcaataaggccatagaggtcgcaggctcctcaacggcagacggtgccaaattacagcaaaacggttttacaaacgcaaccaatcagcaatggaaatttgtcgcagttaacaattaa

SEQ ID NO: 84 - protein, 566 aa, Paenibacillus tundra
MLKKMLNYCKFMLILALLLSITPLGSGRADAWVGMPMGKLHVSGKNLVNSSNQPVVMSGWHQPSGAYWTYQNSNYYLTRNGNNRHAATLAYLKDITDTFTSTSPKYGSSHGWNMNQIRLFIDREDMGDVAAGTYNFAGIQTVTQNVIIPYIQYAKTKGVYVTLGLDFTLKDDQATTAANLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAHDNMSILQDQWNTNVKAAADKYPINITEVTWFKTKPGDSEYWNLFNGSNEGFGNNTKTIFNAAGNVSIAAHMNGFILDAGERSSFADPTAGLKWDGDASRSAMGRFLFDWFYERAQSYPNGGTPSTGLTPGATYKIVARHSGKVIDVPGGVNESNLQLQQWSDLGGNPQKWVLTQIASGIYSLTSVNSPDKVIDIRNGTSNNGEAVQLMSNLNTTAQHFKINDLGNGYWSIINVNSNKAIEVAGSSTADGAKLQQNGFTNATNQQWKFVAVNN

SEQ ID NO: 85 - protein, 535 aa, Paenibacillus tundra
  mat_peptide (1)..(535)
WVGMPMGKLHVSGKNLVNSSNQPVVMSGWHQPSGAYWTYQNSNYYLTRNGNNRHAATLAYLKDITDTFTSTSPKYGSSHGWNMNQIRLFIDREDMGDVAAGTYNFAGIQTVTQNVIIPYIQYAKTKGVYVTLGLDFTLKDDQATTAANLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAHDNMSILQDQWNTNVKAAADKYPINITEVTWFKTKPGDSEYWNLFNGSNEGFGNNTKTIFNAAGNVSIAAHMNGFILDAGERSSFADPTAGLKWDGDASRSAMGRFLFDWFYERAQSYPNGGTPSTGLTPGATYKIVARHSGKVIDVPGGVNESNLQLQQWSDLGGNPQKWVLTQIASGIYSLTSVNSPDKVIDIRNGTSNNGEAVQLMSNLNTTAQHFKINDLGNGYWSIINVNSNKAIEVAGSSTADGAKLQQNGFTNATNQQWKFVAVNN

SEQ ID NO: 86 - DNA, 1713 bp, Artificial sequence
  Synthetic construct
  CDS (1)..(1710)
  sig_peptide (1)..(81)
  mat_peptide (82)..(1710)
atgaagaaaccgttggggaaaattgtcgcaagcaccgcactactcatttctgttgcttttagttcatcgatagcatcagcacatcatcatcaccatcatcctaggtgggttggcatgcctatgggcaagcttcacgtcagtgggaaaaatctagtgaacagcagtaaccaacccgtcgtaatgagtggctggcatcagccctcaggagcctactggacctaccagaacagcaactattatctcactcgaaacggcaacaaccgccatgccgctacattggcttatctgaaagacattaccgatacatttacaagtacaagtcctaaatacggaagcagccacggctggaatatgaatcagattcgtctgttcattgaccgcgaggacatgggagacgtagcagcaggcacttataattttgctggtatacaaactgtaacgcagaacgtcattatcccttatatccaatatgcaaaaacgaaaggcgtctatgttacactcggacttgacttcacattgaaggatgatcaagctacgaccgcagccaatctgcaaaagttcaatcaaatctggggttatctcgcttctcgcccggaaattaaaagcgcagacaacgtacactttgagctaatcaatgagccggttaaatcgtatgctaacggacattggggcggctacaacggcgagaacgactttgtggatcactggaatgatctgcgcaatttccagaactccatcatctcaaccatccgcagccaaggcgcggataatgttatctgggccgctggtttggggtacaaccaattctatagtctgacagcaagccatcccttaacagaccctttgaacaattacggttatgccgttcactggtatccggggtacggagcgcatgacaacatgtcgattctgcaagatcagtggaatacgaatgtgaaggctgcggctgataaatatccgattaacatcaccgaagtcacgtggttcaaaacgaagccgggcgattccgaatactggaatctgttcaacggcagtaatgaaggttttggcaacaatacgaagaccattttcaacgcggcaggcaatgtcagcattgcagcacatatgaacggcttcattttggatgccggggaacgaagctcctttgccgatccgacggcaggcctgaaatgggacggtgatgcttcacggagcgcgatgggacgttttctgttcgattggttctatgaacgcgcacagtcttacccgaacggtggcactccatcaacgggattgacgccgggggcaacctacaagatcgtggctagacattcgggcaaagttatagatgtaccgggtggggtaaatgagagcaatttgcagcttcagcaatggtctgatctgggcggcaatcctcaaaagtgggtcctgacccagattgctagtggaatttacagtttgacgagtgtaaattcgcccgataaggtcatcgacattcgtaatgggacaagtaacaacggagaggcagtacaactcatgagcaatttgaataccaccgcgcagcattttaaaatcaacgatctgggcaatggctattggagtattataaacgtcaacagcaataaggccatagaggtcgcaggctcctcaacggcagacggtgccaaattacagcaaaacggttttacaaacgcaaccaatcagcaatggaaatttgtcgcagttaacaattaa

SEQ ID NO: 87 - protein, 570 aa, Artificial sequence
  Synthetic Construct
MKKPLGKIVASTALLISVAFSSSIASAHHHHHHPRWVGMPMGKLHVSGKNLVNSSNQPVVMSGWHQPSGAYWTYQNSNYYLTRNGNNRHAATLAYLKDITDTFTSTSPKYGSSHGWNMNQIRLFIDREDMGDVAAGTYNFAGIQTVTQNVIIPYIQYAKTKGVYVTLGLDFTLKDDQATTAANLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAHDNMSILQDQWNTNVKAAADKYPINITEVTWFKTKPGDSEYWNLFNGSNEGFGNNTKTIFNAAGNVSIAAHMNGFILDAGERSSFADPTAGLKWDGDASRSAMGRFLFDWFYERAQSYPNGGTPSTGLTPGATYKIVARHSGKVIDVPGGVNESNLQLQQWSDLGGNPQKWVLTQIASGIYSLTSVNSPDKVIDIRNGTSNNGEAVQLMSNLNTTAQHFKINDLGNGYWSIINVNSNKAIEVAGSSTADGAKLQQNGFTNATNQQWKFVAVNN

SEQ ID NO: 88 - protein, 543 aa, Artificial sequence
  Synthetic construct
  mat_peptide (1)..(543)
HHHHHHPRWVGMPMGKLHVSGKNLVNSSNQPVVMSGWHQPSGAYWTYQNSNYYLTRNGNNRHAATLAYLKDITDTFTSTSPKYGSSHGWNMNQIRLFIDREDMGDVAAGTYNFAGIQTVTQNVIIPYIQYAKTKGVYVTLGLDFTLKDDQATTAANLQKFNQIWGYLASRPEIKSADNVHFELINEPVKSYANGHWGGYNGENDFVDHWNDLRNFQNSIISTIRSQGADNVIWAAGLGYNQFYSLTASHPLTDPLNNYGYAVHWYPGYGAHDNMSILQDQWNTNVKAAADKYPINITEVTWFKTKPGDSEYWNLFNGSNEGFGNNTKTIFNAAGNVSIAAHMNGFILDAGERSSFADPTAGLKWDGDASRSAMGRFLFDWFYERAQSYPNGGTPSTGLTPGATYKIVARHSGKVIDVPGGVNESNLQLQQWSDLGGNPQKWVLTQIASGIYSLTSVNSPDKVIDIRNGTSNNGEAVQLMSNLNTTAQHFKINDLGNGYWSIINVNSNKAIEVAGSSTADGAKLQQNGFTNATNQQWKFVAVNN

SEQ ID NO: 89 - DNA, 1707 bp, Paenibacillus species
  CDS (1)..(1704)
  sig_peptide (1)..(96)
  mat_peptide (97)..(1704)
atgattaaaaagaaagtcggtttggcaatgaagcttctgctgcttgtggcgctagtgatgtcgccaatgctgctgagcggcaagaaggcagatgcgtgggttggcatgccgatgtccaagctccatgtaagcggcaaccaattggtgaacagcagtggacagcctgttttgctaagcgggtggcatcagccttcgggcgcttattggacgtaccagaacagcaattactacctgaatcagaatggcgggaatcgacatgcagcgatcttagcgtatttgaaagatatcaccgacacctttacaagcacctcggccaaatacggcaacaaccatggatggtatatgaatcaggtacgtctattcattgaccgggaagacatgggcgacgtagcggcgggcacgtacaattttgccggcctgcaggccgttactcagaacgtcatcattccttatatcaactatgccaagaccaagggactgtatgtcaccctcggcctagatttcactttaagcaacaaccaagcaacaacgcctgccaatctcgcaaagtttaatcagatttggggttacctcgctgatcagccaggaatcaagagcgctgacaatgttatgttcgagctcattaacgagcccgtactgtctgatgtcaatggcgtctggggcggtcatccttcccaatccaatttcattgcgtactggaactcgctcaaaaatttccaaaattccatgatctccaccattcgcagcaaaggcgcggataacgtcatctgggcatcgggacttggttgggatcaatactatcagctatgcgcagcctatccattgacggattcactaaacaatataggttattccgtacattggtatccgggctatggcgcttatgatgactacactcctttgcaacagcaatgggacaccaatattaagccatgcgctgataattatccaattaatattacagagacaacctggttcaagacccaaccgggagactcttcctactgggatctgttcaacggctcgaacgcgggcttcggcaaaaataccaaagcgatcttcacagcagcgggcaatgtgagcatcgctgtccatatgaacggatttttgttgaatcccggcacgagaagctcattcgcagacccaacaggcggtttgatgtatgatggcaacactgcccgggacggcatggcccgatttattttcgaatggtactatgaacgtgcgcagtttaatccttggaatggtatatggaatggagtcacgaatggcgcaacttacaagctcgtcaaccgcgcttcgagtaaaatactcgaggttccaggcggccagaatactaatgcgttgcagcttcaacagcgggcagacaataatacgacagctcagcgctggatcgtcacggatcaaggcacctacaataactattacgaattgcgaagcgtaagctcatccgacaacaaagtcatggatgttcgtaacgggacaaaaaacaatggggaagcgattcagcttatgcaggatctctccaataccgcgcagcagttcagattgatcaagctcagcaacggttactggagcatcttgaatgtgaatagcaacaaagcgatagaggtcaccggctcctccacggctgatggcgcgaatattcagcaaaacttatacagcggcaatctcaatcagcaatggcagctggtacagattaactag

SEQ ID NO: 90 - protein, 568 aa, Paenibacillus species
MIKKKVGLAMKLLLLVALVMSPMLLSGKKADAWVGMPMSKLHVSGNQLVNSSGQPVLLSGWHQPSGAYWTYQNSNYYLNQNGGNRHAAILAYLKDITDTFTSTSAKYGNNHGWYMNQVRLFIDREDMGDVAAGTYNFAGLQAVTQNVIIPYINYAKTKGLYVTLGLDFTLSNNQATTPANLAKFNQIWGYLADQPGIKSADNVMFELINEPVLSDVNGVWGGHPSQSNFIAYWNSLKNFQNSMISTIRSKGADNVIWASGLGWDQYYQLCAAYPLTDSLNNIGYSVHWYPGYGAYDDYTPLQQQWDTNIKPCADNYPINITETTWFKTQPGDSSYWDLFNGSNAGFGKNTKAIFTAAGNVSIAVHMNGFLLNPGTRSSFADPTGGLMYDGNTARDGMARFIFEWYYERAQFNPWNGIWNGVTNGATYKLVNRASSKILEVPGGQNTNALQLQQRADNNTTAQRWIVTDQGTYNNYYELRSVSSSDNKVMDVRNGTKNNGEAIQLMQDLSNTAQQFRLIKLSNGYWSILNVNSNKAIEVTGSSTADGANIQQNLYSGNLNQQWQLVQIN

SEQ ID NO: 91 - protein, 536 aa, Paenibacillus species
  mat_peptide (1)..(536)
WVGMPMSKLHVSGNQLVNSSGQPVLLSGWHQPSGAYWTYQNSNYYLNQNGGNRHAAILAYLKDITDTFTSTSAKYGNNHGWYMNQVRLFIDREDMGDVAAGTYNFAGLQAVTQNVIIPYINYAKTKGLYVTLGLDFTLSNNQATTPANLAKFNQIWGYLADQPGIKSADNVMFELINEPVLSDVNGVWGGHPSQSNFIAYWNSLKNFQNSMISTIRSKGADNVIWASGLGWDQYYQLCAAYPLTDSLNNIGYSVHWYPGYGAYDDYTPLQQQWDTNIKPCADNYPINITETTWFKTQPGDSSYWDLFNGSNAGFGKNTKAIFTAAGNVSIAVHMNGFLLNPGTRSSFADPTGGLMYDGNTARDGMARFIFEWYYERAQFNPWNGIWNGVTNGATYKLVNRASSKILEVPGGQNTNALQLQQRADNNTTAQRWIVTDQGTYNNYYELRSVSSSDNKVMDVRNGTKNNGEAIQLMQDLSNTAQQFRLIKLSNGYWSILNVNSNKAIEVTGSSTADGANIQQNLYSGNLNQQWQLVQIN

SEQ ID NO: 92 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtgggttggcatgccgatgtccaagctccatgtaagcggcaaccaattggtgaacagcagtggacagcctgttttgctaagcgggtggcatcagccttcgggcgcttattggacgtaccagaacagcaattactacctgaatcagaatggcgggaatcgacatgcagcgatcttagcgtatttgaaagatatcaccgacacctttacaagcacctcggccaaatacggcaacaaccatggatggtatatgaatcaggtacgtctattcattgaccgggaagacatgggcgacgtagcggcgggcacgtacaattttgccggcctgcaggccgttactcagaacgtcatcattccttatatcaactatgccaagaccaagggactgtatgtcaccctcggcctagatttcactttaagcaacaaccaagcaacaacgcctgccaatctcgcaaagtttaatcagatttggggttacctcgctgatcagccaggaatcaagagcgctgacaatgttatgttcgagctcattaacgagcccgtactgtctgatgtcaatggcgtctggggcggtcatccttcccaatccaatttcattgcgtactggaactcgctcaaaaatttccaaaattccatgatctccaccattcgcagcaaaggcgcggataacgtcatctgggcatcgggacttggttgggatcaatactatcagctatgcgcagcctatccattgacggattcactaaacaatataggttattccgtacattggtatccgggctatggcgcttatgatgactacactcctttgcaacagcaatgggacaccaatattaagccatgcgctgataattatccaattaatattacagagacaacctggttcaagacccaaccgggagactcttcctactgggatctgttcaacggctcgaacgcgggcttcggcaaaaataccaaagcgatcttcacagcagcgggcaatgtgagcatcgctgtccatatgaacggatttttgttgaatcccggcacgagaagctcattcgcagacccaacaggcggtttgatgtatgatggcaacactgcccgggacggcatggcccgatttattttcgaatggtactatgaacgtgcgcagtttaatccttggaatggtatatggaatggagtcacgaatggcgcaacttacaagctcgtcaaccgcgcttcgagtaaaatactcgaggttccaggcggccagaatactaatgcgttgcagcttcaacagcgggcagacaataatacgacagctcagcgctggatcgtcacggatcaaggcacctacaataactattacgaattgcgaagcgtaagctcatccgacaacaaagtcatggatgttcgtaacgggacaaaaaacaatggggaagcgattcagcttatgcaggatctctccaataccgcgcagcagttcagattgatcaagctcagcaacggttactggagcatcttgaatgtgaatagcaacaaagcgatagaggtcaccggctcctccacggctgatggcgcgaatattcagcaaaacttatacagcggcaatctcaatcagcaatggcagctggtacagattaactag

SEQ ID NO: 93 - protein, 571 aa, Artificial sequence
  Synthetic Construct
MKKPLGKIVASTALLISVAFSSSIASAHHHHHHPRWVGMPMSKLHVSGNQLVNSSGQPVLLSGWHQPSGAYWTYQNSNYYLNQNGGNRHAAILAYLKDITDTFTSTSAKYGNNHGWYMNQVRLFIDREDMGDVAAGTYNFAGLQAVTQNVIIPYINYAKTKGLYVTLGLDFTLSNNQATTPANLAKFNQIWGYLADQPGIKSADNVMFELINEPVLSDVNGVWGGHPSQSNFIAYWNSLKNFQNSMISTIRSKGADNVIWASGLGWDQYYQLCAAYPLTDSLNNIGYSVHWYPGYGAYDDYTPLQQQWDTNIKPCADNYPINITETTWFKTQPGDSSYWDLFNGSNAGFGKNTKAIFTAAGNVSIAVHMNGFLLNPGTRSSFADPTGGLMYDGNTARDGMARFIFEWYYERAQFNPWNGIWNGVTNGATYKLVNRASSKILEVPGGQNTNALQLQQRADNNTTAQRWIVTDQGTYNNYYELRSVSSSDNKVMDVRNGTKNNGEAIQLMQDLSNTAQQFRLIKLSNGYWSILNVNSNKAIEVTGSSTADGANIQQNLYSGNLNQQWQLVQIN

SEQ ID NO: 94 - protein, 544 aa, Artificial sequence
  Synthetic construct
  mat_peptide (1)..(544)
HHHHHHPRWVGMPMSKLHVSGNQLVNSSGQPVLLSGWHQPSGAYWTYQNSNYYLNQNGGNRHAAILAYLKDITDTFTSTSAKYGNNHGWYMNQVRLFIDREDMGDVAAGTYNFAGLQAVTQNVIIPYINYAKTKGLYVTLGLDFTLSNNQATTPANLAKFNQIWGYLADQPGIKSADNVMFELINEPVLSDVNGVWGGHPSQSNFIAYWNSLKNFQNSMISTIRSKGADNVIWASGLGWDQYYQLCAAYPLTDSLNNIGYSVHWYPGYGAYDDYTPLQQQWDTNIKPCADNYPINITETTWFKTQPGDSSYWDLFNGSNAGFGKNTKAIFTAAGNVSIAVHMNGFLLNPGTRSSFADPTGGLMYDGNTARDGMARFIFEWYYERAQFNPWNGIWNGVTNGATYKLVNRASSKILEVPGGQNTNALQLQQRADNNTTAQRWIVTDQGTYNNYYELRSVSSSDNKVMDVRNGTKNNGEAIQLMQDLSNTAQQFRLIKLSNGYWSILNVNSNKAIEVTGSSTADGANIQQNLYSGNLNQQWQLVQIN

SEQ ID NO: 95 - DNA, 1704 bp, Paenibacillus species
  CDS (1)..(1701)
  sig_peptide (1)..(93)
  mat_peptide (94)..(1701)
atgaaaagaaccggatggacgctcaagctgttattggcggtgctgctcctgttgccggcaacgcagggactccatcatggcgcggccgatgcatggtcgggcatgccgatgtccaagcttcacgtcagcggcaaccaactggtaaacagcgaggggcagcccgttgtcctgagcggatggcaccagcccggtggctcgtactggacttatcagggaagcaattactacctgaaccggaatggggggaatcgtcatgctgccattttggagtatttaaaggatattaccgacacattctccgatccctctccgaagtacggcaacaatcacggctggtatatgaaccaggttaggctctttatcgaccgcgaagacatgggcgacgtggcggccggaacgtataattttgcgggcttgcagtcctttacgaagaatgtcgtagtgccttatatccagtatgccaagaccaaaggaatctacgttacgctaggcctcgacttcacactccaggataatcgggccacgacgcaggccaatctcgagaaattcaatcaaatctggggatatcttgcctcgcaaccggcgatcaaaagcgcggacaacgttatgttcgagatcattaatgaaccggttctgtcctatgcgaacggacgttggggaggcaacccttccgatcctgatttcccggcgttttgggactcgctgcgccattttcaaaattccatcatttccacgatccgcagtcaaggggcggataacgtgatatgggccgccggcctaggatgggatcaatattatcagctatgcgccacccgtccgttaaccgatccgctgaacaacatcggatacgctgtccattggtacccgggctacggagcaaaggataacgcttcgatacttcagcagcaatgggataccagcatcaagccttgcgcagacaactatccgatcaatattacggaaacgacctggtttaaacggctgccgggtgactcggagtactgggaactgttcaacggatcgagcgaaggtttcggcaaaaacaccaaagccatatttacggcagccggaaacgtcagcatcgcggtccacatgaacggttttctccttcagccgggggcaagaagcacgtttgccgatccgacggcagggctgctctacgacggcgatccggcacgggacggcatggcccgctttatcttcgaatggtactatgaacgtgcgcagcttcatccgtggaacgggatgtggaacgggattacgtcgggggaaacctataaaatcgtgaatcgcgcctcgggcaaggtgatcgacgtccccggcggtcaaaacagtaattcactgcagctgcagcaatggccagacaataacgctacggcgcagcgatggattgccgatgatatgggagcatacaacaatctgtaccggcttcgcagcgtcagctcgagcgacggcaaggtgatggatgttagaaacggttcgaaaaacaacggggaagcgatacagctcatggaggattacggaaattcggcgcagcgattccgcctgatcaagctcagcaacggatattggagcatccttaacgcgaacagcaataaagccgtcgaagtggcgggggggtcgtccgccgacggggcgaagctccagcagaacccttatcgcggggatttgcatcagcaatggcagttgatccttgtgaattga

SEQ ID NO: 96 - protein, 567 aa, Paenibacillus species
MKRTGWTLKLLLAVLLLLPATQGLHHGAADAWSGMPMSKLHVSGNQLVNSEGQPVVLSGWHQPGGSYWTYQGSNYYLNRNGGNRHAAILEYLKDITDTFSDPSPKYGNNHGWYMNQVRLFIDREDMGDVAAGTYNFAGLQSFTKNVVVPYIQYAKTKGIYVTLGLDFTLQDNRATTQANLEKFNQIWGYLASQPAIKSADNVMFEIINEPVLSYANGRWGGNPSDPDFPAFWDSLRHFQNSIISTIRSQGADNVIWAAGLGWDQYYQLCATRPLTDPLNNIGYAVHWYPGYGAKDNASILQQQWDTSIKPCADNYPINITETTWFKRLPGDSEYWELFNGSSEGFGKNTKAIFTAAGNVSIAVHMNGFLLQPGARSTFADPTAGLLYDGDPARDGMARFIFEWYYERAQLHPWNGMWNGITSGETYKIVNRASGKVIDVPGGQNSNSLQLQQWPDNNATAQRWIADDMGAYNNLYRLRSVSSSDGKVMDVRNGSKNNGEAIQLMEDYGNSAQRFRLIKLSNGYWSILNANSNKAVEVAGGSSADGAKLQQNPYRGDLHQQWQLILVN

SEQ ID NO: 97 - protein, 536 aa, Paenibacillus species
  mat_peptide (1)..(536)
WSGMPMSKLHVSGNQLVNSEGQPVVLSGWHQPGGSYWTYQGSNYYLNRNGGNRHAAILEYLKDITDTFSDPSPKYGNNHGWYMNQVRLFIDREDMGDVAAGTYNFAGLQSFTKNVVVPYIQYAKTKGIYVTLGLDFTLQDNRATTQANLEKFNQIWGYLASQPAIKSADNVMFEIINEPVLSYANGRWGGNPSDPDFPAFWDSLRHFQNSIISTIRSQGADNVIWAAGLGWDQYYQLCATRPLTDPLNNIGYAVHWYPGYGAKDNASILQQQWDTSIKPCADNYPINITETTWFKRLPGDSEYWELFNGSSEGFGKNTKAIFTAAGNVSIAVHMNGFLLQPGARSTFADPTAGLLYDGDPARDGMARFIFEWYYERAQLHPWNGMWNGITSGETYKIVNRASGKVIDVPGGQNSNSLQLQQWPDNNATAQRWIADDMGAYNNLYRLRSVSSSDGKVMDVRNGSKNNGEAIQLMEDYGNSAQRFRLIKLSNGYWSILNANSNKAVEVAGGSSADGAKLQQNPYRGDLHQQWQLILVN

SEQ ID NO: 98 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtggtcgggcatgccgatgtccaagcttcacgtcagcggcaaccaactggtaaacagcgaggggcagcccgttgtcctgagcggatggcaccagcccggtggctcgtactggacttatcagggaagcaattactacctgaaccggaatggggggaatcgtcatgctgccattttggagtatttaaaggatattaccgacacattctccgatccctctccgaagtacggcaacaatcacggctggtatatgaaccaggttaggctctttatcgaccgcgaagacatgggcgacgtggcggccggaacgtataattttgcgggcttgcagtcctttacgaagaatgtcgtagtgccttatatccagtatgccaagaccaaaggaatctacgttacgctaggcctcgacttcacactccaggataatcgggccacgacgcaggccaatctcgagaaattcaatcaaatctggggatatcttgcctcgcaaccggcgatcaaaagcgcggacaacgttatgttcgagatcattaatgaaccggttctgtcctatgcgaacggacgttggggaggcaacccttccgatcctgatttcccggcgttttgggactcgctgcgccattttcaaaattccatcatttccacgatccgcagtcaaggggcggataacgtgatatgggccgccggcctaggatgggatcaatattatcagctatgcgccacccgtccgttaaccgatccgctgaacaacatcggatacgctgtccattggtacccgggctacggagcaaaggataacgcttcgatacttcagcagcaatgggataccagcatcaagccttgcgcagacaactatccgatcaatattacggaaacgacctggtttaaacggctgccgggtgactcggagtactgggaactgttcaacggatcgagcgaaggtttcggcaaaaacaccaaagccatatttacggcagccggaaacgtcagcatcgcggtccacatgaacggttttctccttcagccgggggcaagaagcacgtttgccgatccgacggcagggctgctctacgacggcgatccggcacgggacggcatggcccgctttatcttcgaatggtactatgaacgtgcgcagcttcatccgtggaacgggatgtggaacgggattacgtcgggggaaacctataaaatcgtgaatcgcgcctcgggcaaggtgatcgacgtccccggcggtcaaaacagtaattcactgcagctgcagcaatggccagacaataacgctacggcgcagcgatggattgccgatgatatgggagcatacaacaatctgtaccggcttcgcagcgtcagctcgagcgacggcaaggtgatggatgttagaaacggttcgaaaaacaacggggaagcgatacagctcatggaggattacggaaattcggcgcagcgattccgcctgatcaagctcagcaacggatattggagcatccttaacgcgaacagcaataaagccgtcgaagtggcgggggggtcgtccgccgacggggcgaagctccagcagaacccttatcgcggggatttgcatcagcaatggcagttgatccttgtgaattga

SEQ ID NO: 99 - protein, 571 aa, Artificial sequence
  Synthetic Construct
MKKPLGKIVASTALLISVAFSSSIASAHHHHHHPRWSGMPMSKLHVSGNQLVNSEGQPVVLSGWHQPGGSYWTYQGSNYYLNRNGGNRHAAILEYLKDITDTFSDPSPKYGNNHGWYMNQVRLFIDREDMGDVAAGTYNFAGLQSFTKNVVVPYIQYAKTKGIYVTLGLDFTLQDNRATTQANLEKFNQIWGYLASQPAIKSADNVMFEIINEPVLSYANGRWGGNPSDPDFPAFWDSLRHFQNSIISTIRSQGADNVIWAAGLGWDQYYQLCATRPLTDPLNNIGYAVHWYPGYGAKDNASILQQQWDTSIKPCADNYPINITETTWFKRLPGDSEYWELFNGSSEGFGKNTKAIFTAAGNVSIAVHMNGFLLQPGARSTFADPTAGLLYDGDPARDGMARFIFEWYYERAQLHPWNGMWNGITSGETYKIVNRASGKVIDVPGGQNSNSLQLQQWPDNNATAQRWIADDMGAYNNLYRLRSVSSSDGKVMDVRNGSKNNGEAIQLMEDYGNSAQRFRLIKLSNGYWSILNANSNKAVEVAGGSSADGAKLQQNPYRGDLHQQWQLILVN

SEQ ID NO: 100 - protein, 544 aa, Artificial sequence
  Synthetic construct
  mat_peptide (1)..(544)
HHHHHHPRWSGMPMSKLHVSGNQLVNSEGQPVVLSGWHQPGGSYWTYQGSNYYLNRNGGNRHAAILEYLKDITDTFSDPSPKYGNNHGWYMNQVRLFIDREDMGDVAAGTYNFAGLQSFTKNVVVPYIQYAKTKGIYVTLGLDFTLQDNRATTQANLEKFNQIWGYLASQPAIKSADNVMFEIINEPVLSYANGRWGGNPSDPDFPAFWDSLRHFQNSIISTIRSQGADNVIWAAGLGWDQYYQLCATRPLTDPLNNIGYAVHWYPGYGAKDNASILQQQWDTSIKPCADNYPINITETTWFKRLPGDSEYWELFNGSSEGFGKNTKAIFTAAGNVSIAVHMNGFLLQPGARSTFADPTAGLLYDGDPARDGMARFIFEWYYERAQLHPWNGMWNGITSGETYKIVNRASGKVIDVPGGQNSNSLQLQQWPDNNATAQRWIADDMGAYNNLYRLRSVSSSDGKVMDVRNGSKNNGEAIQLMEDYGNSAQRFRLIKLSNGYWSILNANSNKAVEVAGGSSADGAKLQQNPYRGDLHQQWQLILVN

SEQ ID NO: 101 - DNA, 1701 bp, Paenibacillus species
  CDS (1)..(1698)
  sig_peptide (1)..(90)
  mat_peptide (91)..(1698)
atgaagaagattgggaaatgggtcaagctgctagtgctgctgacggttctggcggccgccgtgctgccgtccggcgcgccggcgagcgcctggtcgggcatgccgatgtcgaagcttcgcgtcagcggcaaccagctcgtcaacagcagcaatcaaccggtcttgttaagcgggtggcatcagcccacgggctcctattggacctatcagaacagcaactactatttgaaccggaacggagggaaccgacacgcagcgattctggaatatttgaaggatattaccgatactttcacaagcacatcgcccaaatacggcaacaatcacggctggtatatgaatcaggtccggctctttatcgaccggcaggatatgggagacgttgccgcgggaacgtacaattttgccggtttgcagagcgttacgcaaaacgtcatcatcccctatatcgactatgccagaacgaaagggctgtacgtcacgcttggccttgacttcacgctgctaaatgacgaagcgacgacgcagtccaatctcgacaagtttaatcagatttggggatacctcgcggcccagccgggcatcaagagtgcggacaacgtcatgttcgaaatcatcaacgaaccggtgaagtcatatgcgaacgggcgatggggaggacatccttcggatcccgatttcgtggcattctggaactcgctgagaaccttccagaacgccattatttccaccattcgcaatcagggtgcggacaacgtgatctgggcggcaggacttggctgggaccagtattatcagttatgcgcatcgcacccgcttacggatccgctgaacaatctcgggtatgccgttcactggtatccgggctatggggcaaacgacaacaattcggttttgcagcagcagtggaatacgaacatcaaaccttgcgccgatcactttccgattaacattacagagacaacgtggttcaagtggcttccgggagattcttcctattggaacttgttcaacggctcgaacgagggcttcggcaaaaacacaaaagcgatcttcacagcggcgggaaatgtcagcattgccgtgcatatgaacggtttcttgctggagcccggcacaagaagctcgttcgcggacccgaccgccggcttgaagtttgacggcaatgcagcgcgtgacgggatggcccgctttatcttcgaatggtattacgaacgggcgcagatgtacccgtggaacggcatatggaacggcatttcatccggcacaacctacaagatcgtgaaccggcattcgggcaaagtcatcgacgttcccggcggccagaacaacaacgcactgcagctccaacaatgggccgaccttcatacttcggcgcagcggtgggtcgttgacgatatgggaagttccactaatgtataccgattgcggagtgtgagctcatccgacaacaaagtgatggatgtacgaaacgggacgataaacaacggggaagcgatccagcttatgcaggatttcggcaataccgcccaacggttccgattgatcaggctcagcaacggatattggagcatcatcaatataaacagcaacaaagcggttgaagtctccggctcctcgacagcggacggagcgaatctgcagcaaaatccttaccgtggcgatcatcatcagcaatggcaattgatcgcagtgaattaa

SEQ ID NO: 102 - protein, 566 aa, Paenibacillus species
MKKIGKWVKLLVLLTVLAAAVLPSGAPASAWSGMPMSKLRVSGNQLVNSSNQPVLLSGWHQPTGSYWTYQNSNYYLNRNGGNRHAAILEYLKDITDTFTSTSPKYGNNHGWYMNQVRLFIDRQDMGDVAAGTYNFAGLQSVTQNVIIPYIDYARTKGLYVTLGLDFTLLNDEATTQSNLDKFNQIWGYLAAQPGIKSADNVMFEIINEPVKSYANGRWGGHPSDPDFVAFWNSLRTFQNAIISTIRNQGADNVIWAAGLGWDQYYQLCASHPLTDPLNNLGYAVHWYPGYGANDNNSVLQQQWNTNIKPCADHFPINITETTWFKWLPGDSSYWNLFNGSNEGFGKNTKAIFTAAGNVSIAVHMNGFLLEPGTRSSFADPTAGLKFDGNAARDGMARFIFEWYYERAQMYPWNGIWNGISSGTTYKIVNRHSGKVIDVPGGQNNNALQLQQWADLHTSAQRWVVDDMGSSTNVYRLRSVSSSDNKVMDVRNGTINNGEAIQLMQDFGNTAQRFRLIRLSNGYWSIININSNKAVEVSGSSTADGANLQQNPYRGDHHQQWQLIAVN

SEQ ID NO: 103 - protein, 536 aa, Paenibacillus species
  mat_peptide (1)..(536)
WSGMPMSKLRVSGNQLVNSSNQPVLLSGWHQPTGSYWTYQNSNYYLNRNGGNRHAAILEYLKDITDTFTSTSPKYGNNHGWYMNQVRLFIDRQDMGDVAAGTYNFAGLQSVTQNVIIPYIDYARTKGLYVTLGLDFTLLNDEATTQSNLDKFNQIWGYLAAQPGIKSADNVMFEIINEPVKSYANGRWGGHPSDPDFVAFWNSLRTFQNAIISTIRNQGADNVIWAAGLGWDQYYQLCASHPLTDPLNNLGYAVHWYPGYGANDNNSVLQQQWNTNIKPCADHFPINITETTWFKWLPGDSSYWNLFNGSNEGFGKNTKAIFTAAGNVSIAVHMNGFLLEPGTRSSFADPTAGLKFDGNAARDGMARFIFEWYYERAQMYPWNGIWNGISSGTTYKIVNRHSGKVIDVPGGQNNNALQLQQWADLHTSAQRWVVDDMGSSTNVYRLRSVSSSDNKVMDVRNGTINNGEAIQLMQDFGNTAQRFRLIRLSNGYWSIININSNKAVEVSGSSTADGANLQQNPYRGDHHQQWQLIAVN

SEQ ID NO: 104 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtggtcgggcatgccgatgtcgaagcttcgcgtcagcggcaaccagctcgtcaacagcagcaatcaaccggtcttgttaagcgggtggcatcagcccacgggctcctattggacctatcagaacagcaactactatttgaaccggaacggagggaaccgacacgcagcgattctggaatatttgaaggatattaccgatactttcacaagcacatcgcccaaatacggcaacaatcacggctggtatatgaatcaggtccggctctttatcgaccggcaggatatgggagacgttgccgcgggaacgtacaattttgccggtttgcagagcgttacgcaaaacgtcatcatcccctatatcgactatgccagaacgaaagggctgtacgtcacgcttggccttgacttcacgctgctaaatgacgaagcgacgacgcagtccaatctcgacaagtttaatcagatttggggatacctcgcggcccagccgggcatcaagagtgcggacaacgtcatgttcgaaatcatcaacgaaccggtgaagtcatatgcgaacgggcgatggggaggacatccttcggatcccgatttcgtggcattctggaactcgctgagaaccttccagaacgccattatttccaccattcgcaatcagggtgcggacaacgtgatctgggcggcaggacttggctgggaccagtattatcagttatgcgcatcgcacccgcttacggatccgctgaacaatctcgggtatgccgttcactggtatccgggctatggggcaaacgacaacaattcggttttgcagcagcagtggaatacgaacatcaaaccttgcgccgatcactttccgattaacattacagagacaacgtggttcaagtggcttccgggagattcttcctattggaacttgttcaacggctcgaacgagggcttcggcaaaaacacaaaagcgatcttcacagcggcgggaaatgtcagcattgccgtgcatatgaacggtttcttgctggagcccggcacaagaagctcgttcgcggacccgaccgccggcttgaagtttgacggcaatgcagcgcgtgacgggatggcccgctttatcttcgaatggtattacgaacgggcgcagatgtacccgtggaacggcatatggaacggcatttcatccggcacaacctacaagatcgtgaaccggcattcgggcaaagtcatcgacgttcccggcggccagaacaacaacgcactgcagctccaacaatgggccgaccttcatacttcggcgcagcggtgggtcgttgacgatatgggaagttccactaatgtataccgattgcggagtgtgagctcatccgacaacaaagtgatggatgtacgaaacgggacgataaacaacggggaagcgatccagcttatgcaggatttcggcaataccgcccaacggttccgattgatcaggctcagcaacggatattggagcatcatcaatataaacagcaacaaagcggttgaagtctccggctcctcgacagcggacggagcgaatctgcagcaaaatccttaccgtggcgatcatcatcagcaatggcaattgatcgcagtgaattaa

SEQ ID NO: 105 - protein, 571 aa, Artificial sequence
  Synthetic Construct
MKKPLGKIVASTALLISVAFSSSIASAHHHHHHPRWSGMPMSKLRVSGNQLVNSSNQPVLLSGWHQPTGSYWTYQNSNYYLNRNGGNRHAAILEYLKDITDTFTSTSPKYGNNHGWYMNQVRLFIDRQDMGDVAAGTYNFAGLQSVTQNVIIPYIDYARTKGLYVTLGLDFTLLNDEATTQSNLDKFNQIWGYLAAQPGIKSADNVMFEIINEPVKSYANGRWGGHPSDPDFVAFWNSLRTFQNAIISTIRNQGADNVIWAAGLGWDQYYQLCASHPLTDPLNNLGYAVHWYPGYGANDNNSVLQQQWNTNIKPCADHFPINITETTWFKWLPGDSSYWNLFNGSNEGFGKNTKAIFTAAGNVSIAVHMNGFLLEPGTRSSFADPTAGLKFDGNAARDGMARFIFEWYYERAQMYPWNGIWNGISSGTTYKIVNRHSGKVIDVPGGQNNNALQLQQWADLHTSAQRWVVDDMGSSTNVYRLRSVSSSDNKVMDVRNGTINNGEAIQLMQDFGNTAQRFRLIRLSNGYWSIININSNKAVEVSGSSTADGANLQQNPYRGDHHQQWQLIAVN

SEQ ID NO: 106 - protein, 544 aa, Artificial sequence
  Synthetic construct
  mat_peptide (1)..(544)
HHHHHHPRWSGMPMSKLRVSGNQLVNSSNQPVLLSGWHQPTGSYWTYQNSNYYLNRNGGNRHAAILEYLKDITDTFTSTSPKYGNNHGWYMNQVRLFIDRQDMGDVAAGTYNFAGLQSVTQNVIIPYIDYARTKGLYVTLGLDFTLLNDEATTQSNLDKFNQIWGYLAAQPGIKSADNVMFEIINEPVKSYANGRWGGHPSDPDFVAFWNSLRTFQNAIISTIRNQGADNVIWAAGLGWDQYYQLCASHPLTDPLNNLGYAVHWYPGYGANDNNSVLQQQWNTNIKPCADHFPINITETTWFKWLPGDSSYWNLFNGSNEGFGKNTKAIFTAAGNVSIAVHMNGFLLEPGTRSSFADPTAGLKFDGNAARDGMARFIFEWYYERAQMYPWNGIWNGISSGTTYKIVNRHSGKVIDVPGGQNNNALQLQQWADLHTSAQRWVVDDMGSSTNVYRLRSVSSSDNKVMDVRNGTINNGEAIQLMQDFGNTAQRFRLIRLSNGYWSIININSNKAVEVSGSSTADGANLQQNPYRGDHHQQWQLIAVN

SEQ ID NO: 107 - DNA, 1698 bp, Paenibacillus species
  CDS (1)..(1695)
  sig_peptide (1)..(87)
  mat_peptide (88)..(1695)
atgaagaggtttggcatggcgatcaagctgttggtgctcatggtgttgatggcagcgccgctgcttagcgcgggtcctgccgaagcgtggacgggcatgccgatgtccaagctgcgcgtgagcggcaatcagctggtgaacggcagcgggcagcccgtgctgctgagcggctggcaccagccgacaggggcgtattggacgtatcagaacagcagctattatttgaaccagcaaggcgggaatcgccatgccgcgattttggcgtacttgaaggatattacggatacgttcacgagcacgtcggccaagtacggcaataaccacggctggtatatgaatcaggtgcgcctgttcatcgaccgggaagacatgggcgatgtcgcggcgggtacgtataatttcgcgggcttgcaggccgtcacgcagaacgtgatcatcccgtatatcgcctatgccaagacgaaagggctttatgtgacgctgggccttgatttcaccctgcagaataatcaagcgaccacgacagccaatctggacaaattcaatcagatctggggctatcttgcctcgcagccggccatcaagagcgcggacaacgtcatgttcgagctcgtcaacgagcccgtgttgtcgtatgcgaacggcggatggggcggtaatccgatcgaatccgatttcgtcgcccattggaacgcgctgcgggatttccagaactccatgatcgccaccattcgcggcaaaggtgcggataacgtgatctgggcggcgggacttggctgggatcaatattatcagctgtgcgccaccaatccgctcacggatccgctgaacaatgtcggctattcggtccactggtatccgggctacggcgcgaatgacaattattcggtgctgcagcagcagtgggacaccaatattaaaccatgtgccgacgcctacccgatcaacattacggagacgacttggtttaaatggaagtcgggggattccgagtactggaaactattcgacggcacgaatgcgggctttggcaaaaacaccaaagccatcttcacggccgcgggcaatgtcagcattgccgtccatatgaacggattcctgctcaatcccggcacgagaagctcgttcgccgatccgacggccggcctcatgtatgacggcgacgcgtcgcgggacggcatggcccgcttcatcttcgaatggtattatgaacgcgcgcagttcaacccatggaatggcgtatggaacgggattacgtccggatcgacctacaagctgatcaaccgcgcttcgggcaaagccatcgatgtgcctagcggccagaacaccaacggcttgcagctgcagcagtggacggacaacaacgcaaccgcgcagcggtgggtcgcggatgatctgggcacctacaacaatgtttaccggctgcgcagcgtcagctcctcggataacaaggtgatggatgtgcgcaacgggacgaagaacaacggggaagcgattcagctctggtcggatctgaacaataccgcgcagaaattcaggctgatcaagctgagcaacggctattggagtctgattaacgtgaacagcaataaggcggtagaggtcgccggatcctctacggcggacggagcgaagctccagcagaacctgtaccgcggcgatctgaaccagcagtggcagctcgtgaagattgaatag

SEQ ID NO: 108 - protein, 565 aa, Paenibacillus species
MKRFGMAIKLLVLMVLMAAPLLSAGPAEAWTGMPMSKLRVSGNQLVNGSGQPVLLSGWHQPTGAYWTYQNSSYYLNQQGGNRHAAILAYLKDITDTFTSTSAKYGNNHGWYMNQVRLFIDREDMGDVAAGTYNFAGLQAVTQNVIIPYIAYAKTKGLYVTLGLDFTLQNNQATTTANLDKFNQIWGYLASQPAIKSADNVMFELVNEPVLSYANGGWGGNPIESDFVAHWNALRDFQNSMIATIRGKGADNVIWAAGLGWDQYYQLCATNPLTDPLNNVGYSVHWYPGYGANDNYSVLQQQWDTNIKPCADAYPINITETTWFKWKSGDSEYWKLFDGTNAGFGKNTKAIFTAAGNVSIAVHMNGFLLNPGTRSSFADPTAGLMYDGDASRDGMARFIFEWYYERAQFNPWNGVWNGITSGSTYKLINRASGKAIDVPSGQNTNGLQLQQWTDNNATAQRWVADDLGTYNNVYRLRSVSSSDNKVMDVRNGTKNNGEAIQLWSDLNNTAQKFRLIKLSNGYWSLINVNSNKAVEVAGSSTADGAKLQQNLYRGDLNQQWQLVKIE

SEQ ID NO: 109 - protein, 536 aa, Paenibacillus species
  mat_peptide (1)..(536)
WTGMPMSKLRVSGNQLVNGSGQPVLLSGWHQPTGAYWTYQNSSYYLNQQGGNRHAAILAYLKDITDTFTSTSAKYGNNHGWYMNQVRLFIDREDMGDVAAGTYNFAGLQAVTQNVIIPYIAYAKTKGLYVTLGLDFTLQNNQATTTANLDKFNQIWGYLASQPAIKSADNVMFELVNEPVLSYANGGWGGNPIESDFVAHWNALRDFQNSMIATIRGKGADNVIWAAGLGWDQYYQLCATNPLTDPLNNVGYSVHWYPGYGANDNYSVLQQQWDTNIKPCADAYPINITETTWFKWKSGDSEYWKLFDGTNAGFGKNTKAIFTAAGNVSIAVHMNGFLLNPGTRSSFADPTAGLMYDGDASRDGMARFIFEWYYERAQFNPWNGVWNGITSGSTYKLINRASGKAIDVPSGQNTNGLQLQQWTDNNATAQRWVADDLGTYNNVYRLRSVSSSDNKVMDVRNGTKNNGEAIQLWSDLNNTAQKFRLIKLSNGYWSLINVNSNKAVEVAGSSTADGAKLQQNLYRGDLNQQWQLVKIE

SEQ ID NO: 110 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtggacgggcatgccgatgtccaagctgcgcgtgagcggcaatcagctggtgaacggcagcgggcagcccgtgctgctgagcggctggcaccagccgacaggggcgtattggacgtatcagaacagcagctattatttgaaccagcaaggcgggaatcgccatgccgcgattttggcgtacttgaaggatattacggatacgttcacgagcacgtcggccaagtacggcaataaccacggctggtatatgaatcaggtgcgcctgttcatcgaccgggaagacatgggcgatgtcgcggcgggtacgtataatttcgcgggcttgcaggccgtcacgcagaacgtgatcatcccgtatatcgcctatgccaagacgaaagggctttatgtgacgctgggccttgatttcaccctgcagaataatcaagcgaccacgacagccaatctggacaaattcaatcagatctggggctatcttgcctcgcagccggccatcaagagcgcggacaacgtcatgttcgagctcgtcaacgagcccgtgttgtcgtatgcgaacggcggatggggcggtaatccgatcgaatccgatttcgtcgcccattggaacgcgctgcgggatttccagaactccatgatcgccaccattcgcggcaaaggtgcggataacgtgatctgggcggcgggacttggctgggatcaatattatcagctgtgcgccaccaatccgctcacggatccgctgaacaatgtcggctattcggtccactggtatccgggctacggcgcgaatgacaattattcggtgctgcagcagcagtgggacaccaatattaaaccatgtgccgacgcctacccgatcaacattacggagacgacttggtttaaatggaagtcgggggattccgagtactggaaactattcgacggcacgaatgcgggctttggcaaaaacaccaaagccatcttcacggccgcgggcaatgtcagcattgccgtccatatgaacggattcctgctcaatcccggcacgagaagctcgttcgccgatccgacggccggcctcatgtatgacggcgacgcgtcgcgggacggcatggcccgcttcatcttcgaatggtattatgaacgcgcgcagttcaacccatggaatggcgtatggaacgggattacgtccggatcgacctacaagctgatcaaccgcgcttcgggcaaagccatcgatgtgcctagcggccagaacaccaacggcttgcagctgcagcagtggacggacaacaacgcaaccgcgcagcggtgggtcgcggatgatctgggcacctacaacaatgtttaccggctgcgcagcgtcagctcctcggataacaaggtgatggatgtgcgcaacgggacgaagaacaacggggaagcgattcagctctggtcggatctgaacaataccgcgcagaaattcaggctgatcaagctgagcaacggctattggagtctgattaacgtgaacagcaataaggcggtagaggtcgccggatcctctacggcggacggagcgaagctccagcagaacctgtaccgcggcgatctgaaccagcagtggcagctcgtgaagattgaatag

SEQ ID NO: 111 - protein, 571 aa, Artificial sequence
  Synthetic Construct
MKKPLGKIVASTALLISVAFSSSIASAHHHHHHPRWTGMPMSKLRVSGNQLVNGSGQPVLLSGWHQPTGAYWTYQNSSYYLNQQGGNRHAAILAYLKDITDTFTSTSAKYGNNHGWYMNQVRLFIDREDMGDVAAGTYNFAGLQAVTQNVIIPYIAYAKTKGLYVTLGLDFTLQNNQATTTANLDKFNQIWGYLASQPAIKSADNVMFELVNEPVLSYANGGWGGNPIESDFVAHWNALRDFQNSMIATIRGKGADNVIWAAGLGWDQYYQLCATNPLTDPLNNVGYSVHWYPGYGANDNYSVLQQQWDTNIKPCADAYPINITETTWFKWKSGDSEYWKLFDGTNAGFGKNTKAIFTAAGNVSIAVHMNGFLLNPGTRSSFADPTAGLMYDGDASRDGMARFIFEWYYERAQFNPWNGVWNGITSGSTYKLINRASGKAIDVPSGQNTNGLQLQQWTDNNATAQRWVADDLGTYNNVYRLRSVSSSDNKVMDVRNGTKNNGEAIQLWSDLNNTAQKFRLIKLSNGYWSLINVNSNKAVEVAGSSTADGAKLQQNLYRGDLNQQWQLVKIE

SEQ ID NO: 112 - protein, 544 aa, Artificial sequence
  Synthetic construct
  mat_peptide (1)..(544)
HHHHHHPRWTGMPMSKLRVSGNQLVNGSGQPVLLSGWHQPTGAYWTYQNSSYYLNQQGGNRHAAILAYLKDITDTFTSTSAKYGNNHGWYMNQVRLFIDREDMGDVAAGTYNFAGLQAVTQNVIIPYIAYAKTKGLYVTLGLDFTLQNNQATTTANLDKFNQIWGYLASQPAIKSADNVMFELVNEPVLSYANGGWGGNPIESDFVAHWNALRDFQNSMIATIRGKGADNVIWAAGLGWDQYYQLCATNPLTDPLNNVGYSVHWYPGYGANDNYSVLQQQWDTNIKPCADAYPINITETTWFKWKSGDSEYWKLFDGTNAGFGKNTKAIFTAAGNVSIAVHMNGFLLNPGTRSSFADPTAGLMYDGDASRDGMARFIFEWYYERAQFNPWNGVWNGITSGSTYKLINRASGKAIDVPSGQNTNGLQLQQWTDNNATAQRWVADDLGTYNNVYRLRSVSSSDNKVMDVRNGTKNNGEAIQLWSDLNNTAQKFRLIKLSNGYWSLINVNSNKAVEVAGSSTADGAKLQQNLYRGDLNQQWQLVKIE

SEQ ID NO: 113 - DNA, 1707 bp, Paenibacillus xylanexedens
  CDS (1)..(1704)
  sig_peptide (1)..(90)
  mat_peptide (91)..(1704)
gtgaagaagttcatgacatcttgtaaacttgtactcattctggctttattgatcacaattgctccatggggaggcagccgtgccgaagcatgggtgggcatgccgatgggcaagctgcacgtaaacggcaaaaacctggtgaacagcaacaaccagcctgttctactgaacggttggcatcaaccctcaggtgcctactggacgtatcaggacagcaattattacctcaatctgcacggcaataaccgtcatgcagctacactggcttatctgaaagacattaccgatacttttgctgacaccagcgcgaagtacggaagcaatcatggctggaatatgaatcaggtacgtctgttcatcgatcgtcaggatatgggagatgtggctgctggtacatataactttgccggtgtgcagaccgttacgcaaaatgtaattattccgtacattcaatatgccaaaacaaaaggtgtctatgttgtcctgggactggacttcacactgaaggatgatcaggcaacaacacctgccaacctgcaaaaattcaacgaaatctggggttatctcgcttcacgcccggagatcaaaagtgcagacaacgttcacttcgaactgatcaacgaaccggtgaaatcctatgccaatggacattggggtggatacaacggggaaaatgactttgtggatcactggaatgacttgcgtaatttccaaaattccatgatttcaacaattcgtagcaaaggtgcggacaacgtcatctgggcggcaggtctgggatacaaccaattttacagcttgacggcaagccatccattgactgatccgctcaataactatggatatgcggttcactggtaccctggttatggcgcatatgacaacttctctatcctgcaagaccagtggaataccaacgtgaaggcagctgctgacaaatatccgattaatattaccgaggtaacctggttcaaaaacaaacctggcgattcggcctattggaacttgtttaatggtagcaatgaaggttttggcaccaataccaaaacgattttcaacgcatcaggtaatgtcagcattgcagctcatatgaacggattcattctaagtgaaggaccacgaagctcctttgccgacccaacggctggactgaaatgggatggagatgcttcacggagtgccatgggacgattcctgttcaactggtaccatgaacgtgctcagacttacccgggcagtggacaaggcggcggaccgacaacgggtcttgtatccggtgcaacttataaaatcgtagcccggcattccaacaaagttgttgatgttcctggtggtcaaaatgaaaataatcttcagctccagcagtggagtgatctgggcggtaaccctcagaagtgggttctgacctcgatcggcagcggcaactatacactgacaagtgtgaactcgccggacaaagtcatcgacattcgcaacggtaccctcaccaatggggaagcggttcaactcatgagcaatctgaacacaaccgctcagcattttaaggtcaacgatcttggtaacgggtactggagtatcatcaacgtgaacagcaataaagcgattgaagtagcaaacgcttccacttcggatggagccttgctgcagcagaacacctacacaggtgctacaaaccaacaatggaaatttgttgccgttagcaattaa

SEQ ID NO: 114 - protein, 568 aa, Paenibacillus xylanexedens
VKKFMTSCKLVLILALLITIAPWGGSRAEAWVGMPMGKLHVNGKNLVNSNNQPVLLNGWHQPSGAYWTYQDSNYYLNLHGNNRHAATLAYLKDITDTFADTSAKYGSNHGWNMNQVRLFIDRQDMGDVAAGTYNFAGVQTVTQNVIIPYIQYAKTKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNASGNVSIAAHMNGFILSEGPRSSFADPTAGLKWDGDASRSAMGRFLFNWYHERAQTYPGSGQGGGPTTGLVSGATYKIVARHSNKVVDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGALLQQNTYTGATNQQWKFVAVSN

SEQ ID NO: 115 - protein, 538 aa, Paenibacillus xylanexedens
  mat_peptide (1)..(538)
WVGMPMGKLHVNGKNLVNSNNQPVLLNGWHQPSGAYWTYQDSNYYLNLHGNNRHAATLAYLKDITDTFADTSAKYGSNHGWNMNQVRLFIDRQDMGDVAAGTYNFAGVQTVTQNVIIPYIQYAKTKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNASGNVSIAAHMNGFILSEGPRSSFADPTAGLKWDGDASRSAMGRFLFNWYHERAQTYPGSGQGGGPTTGLVSGATYKIVARHSNKVVDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGALLQQNTYTGATNQQWKFVAVSN

SEQ ID NO: 116 - DNA, 1722 bp, Artificial sequence
  Synthetic construct
  CDS (1)..(1719)
  sig_peptide (1)..(81)
  mat_peptide (82)..(1719)
atgaagaaaccgttggggaaaattgtcgcaagcaccgcactactcatttctgttgcttttagttcatcgatagcatcagcacatcatcatcaccatcatcctaggtgggtgggcatgccgatgggcaagctgcacgtaaacggcaaaaacctggtgaacagcaacaaccagcctgttctactgaacggttggcatcaaccctcaggtgcctactggacgtatcaggacagcaattattacctcaatctgcacggcaataaccgtcatgcagctacactggcttatctgaaagacattaccgatacttttgctgacaccagcgcgaagtacggaagcaatcatggctggaatatgaatcaggtacgtctgttcatcgatcgtcaggatatgggagatgtggctgctggtacatataactttgccggtgtgcagaccgttacgcaaaatgtaattattccgtacattcaatatgccaaaacaaaaggtgtctatgttgtcctgggactggacttcacactgaaggatgatcaggcaacaacacctgccaacctgcaaaaattcaacgaaatctggggttatctcgcttcacgcccggagatcaaaagtgcagacaacgttcacttcgaactgatcaacgaaccggtgaaatcctatgccaatggacattggggtggatacaacggggaaaatgactttgtggatcactggaatgacttgcgtaatttccaaaattccatgatttcaacaattcgtagcaaaggtgcggacaacgtcatctgggcggcaggtctgggatacaaccaattttacagcttgacggcaagccatccattgactgatccgctcaataactatggatatgcggttcactggtaccctggttatggcgcatatgacaacttctctatcctgcaagaccagtggaataccaacgtgaaggcagctgctgacaaatatccgattaatattaccgaggtaacctggttcaaaaacaaacctggcgattcggcctattggaacttgtttaatggtagcaatgaaggttttggcaccaataccaaaacgattttcaacgcatcaggtaatgtcagcattgcagctcatatgaacggattcattctaagtgaaggaccacgaagctcctttgccgacccaacggctggactgaaatgggatggagatgcttcacggagtgccatgggacgattcctgttcaactggtaccatgaacgtgctcagacttacccgggcagtggacaaggcggcggaccgacaacgggtcttgtatccggtgcaacttataaaatcgtagcccggcattccaacaaagttgttgatgttcctggtggtcaaaatgaaaataatcttcagctccagcagtggagtgatctgggcggtaaccctcagaagtgggttctgacctcgatcggcagcggcaactatacactgacaagtgtgaactcgccggacaaagtcatcgacattcgcaacggtaccctcaccaatggggaagcggttcaactcatgagcaatctgaacacaaccgctcagcattttaaggtcaacgatcttggtaacgggtactggagtatcatcaacgtgaacagcaataaagcgattgaagtagcaaacgcttccacttcggatggagccttgctgcagcagaacacctacacaggtgctacaaaccaacaatggaaatttgttgccgttagcaattaa

SEQ ID NO: 117 - protein, 573 aa, Artificial sequence
  Synthetic Construct
MKKPLGKIVASTALLISVAFSSSIASAHHHHHHPRWVGMPMGKLHVNGKNLVNSNNQPVLLNGWHQPSGAYWTYQDSNYYLNLHGNNRHAATLAYLKDITDTFADTSAKYGSNHGWNMNQVRLFIDRQDMGDVAAGTYNFAGVQTVTQNVIIPYIQYAKTKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNASGNVSIAAHMNGFILSEGPRSSFADPTAGLKWDGDASRSAMGRFLFNWYHERAQTYPGSGQGGGPTTGLVSGATYKIVARHSNKVVDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGALLQQNTYTGATNQQWKFVAVSN

SEQ ID NO: 118 - protein, 546 aa, Artificial sequence
  Synthetic construct
  mat_peptide (1)..(546)
HHHHHHPRWVGMPMGKLHVNGKNLVNSNNQPVLLNGWHQPSGAYWTYQDSNYYLNLHGNNRHAATLAYLKDITDTFADTSAKYGSNHGWNMNQVRLFIDRQDMGDVAAGTYNFAGVQTVTQNVIIPYIQYAKTKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNASGNVSIAAHMNGFILSEGPRSSFADPTAGLKWDGDASRSAMGRFLFNWYHERAQTYPGSGQGGGPTTGLVSGATYKIVARHSNKVVDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGALLQQNTYTGATNQQWKFVAVSN

SEQ ID NO: 119 - DNA, 1704 bp, Paenibacillus chitinolyticus
  CDS (1)..(1701)
  sig_peptide (1)..(90)
  mat_peptide (91)..(1701)
gtgaagaagattttgacatctttcaaacttttaatcattcttgctttattgatcaccattgttccatggggaggtaaccgagccgaggcatgggtgggcatgccgatgggtaagcttcacgttaacggcaaaaacctggtgaacagcaacaaccagcctgtgcttctgaacggttggcatcaaccttcaggcgcctactggacatatcaggatagcaattattacctcaatctacacggtaataaccgtcatgcagctactctggcttatctgaaggacattaccgatacatttgcggataccagcccgaaatacggaagcaatcatggctggaatatgaatcaggtacgtctttttatcgaccgtcaggatatgggagatgtggctgctggtacatataactttgccggtgtgcagaccgttacgcaaaatgtcattattccgtatatccaatatgccaagagcaaaggcgtatatgtggtcctgggactcgacttcacattaaaggatgatcaggcaacaacacctgccaacctgcaaaaattcaacgaaatctggggttatctcgcttcacgcccggagatcaaaagtgcagacaacgttcacttcgaactgatcaacgaaccggtgaaatcctatgccaatggacattggggtggatacaacggggaaaatgactttgtggatcactggaatgacctgcgtaatttccaaaattccatgatttcaacaattcgcagcaaaggtgcggacaatgtcatctgggcggcaggtttgggatacaaccaattttacagcttaacggcaagtcatccattgactgacccgctcaataactatggatatgcggttcactggtaccctggttatggtgcatatgacaatttctctatcctgcaagaccagtggaataccaacgtgaaggcagccgctgacaaatatccaattaacattaccgaggtaacctggttcaaaaacaaacctggcgattcggcctattggaacttgtttaatggcagcaatgaaggtttcggtaccaataccaaaacgattttcaacgcagcaggcaacgtcagcattgcagcacatatgaacggttttattctaagtgaaggaccaagaagctcctttgccgatcctacggcaggcctgaaatgggacggggatgcttcacggagcgcgatgggacgtttcctgtttaactggtaccatgaacgtgctcagacttacccgggcggtgggcaaggtggaccaacaacgggtctggtatccggtgcaacctataaaattgtagctcggcattccaacaaggttattgatgtcccaggtggtcaaaatgaaaacaatcttcaactccagcagtggagcgatctgggcggcaaccctcagaagtgggttctaacttcgattggcagcggcaactacacgctgacaagtgtgaactcaccggacaaagtcatcgacattcgcaacggtactctcaccaatggggaagcggtccaactcatgagcaatctgaacacaaccgctcagcatttcaaagtgaatgaccttggtaacgggtactggagtatcatcaacgtgaacagcaacaaagcgattgaagtcgcaaacgcttccacgtcggatggtgccaaattgcagcagaacacctacacgggtgcaacaaatcaacaatggaaatttgttgccgtcagcaattaa

SEQ ID NO: 120 - protein, 567 aa, Paenibacillus chitinolyticus
VKKILTSFKLLIILALLITIVPWGGNRAEAWVGMPMGKLHVNGKNLVNSNNQPVLLNGWHQPSGAYWTYQDSNYYLNLHGNNRHAATLAYLKDITDTFADTSPKYGSNHGWNMNQVRLFIDRQDMGDVAAGTYNFAGVQTVTQNVIIPYIQYAKSKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILSEGPRSSFADPTAGLKWDGDASRSAMGRFLFNWYHERAQTYPGGGQGGPTTGLVSGATYKIVARHSNKVIDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGAKLQQNTYTGATNQQWKFVAVSN

SEQ ID NO: 121 - protein, 537 aa, Paenibacillus chitinolyticus
  mat_peptide (1)..(537)
WVGMPMGKLHVNGKNLVNSNNQPVLLNGWHQPSGAYWTYQDSNYYLNLHGNNRHAATLAYLKDITDTFADTSPKYGSNHGWNMNQVRLFIDRQDMGDVAAGTYNFAGVQTVTQNVIIPYIQYAKSKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILSEGPRSSFADPTAGLKWDGDASRSAMGRFLFNWYHERAQTYPGGGQGGPTTGLVSGATYKIVARHSNKVIDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGAKLQQNTYTGATNQQWKFVAVSN

SEQ ID NO: 122 - DNA, 1719 bp, Artificial sequence
  Synthetic construct
  CDS (1)..(1716)
  sig_peptide (1)..(81)
  mat_peptide (82)..(1716)
atgaagaaaccgttggggaaaattgtcgcaagcaccgcactactcatttctgttgcttttagttcatcgatagcatcagcacatcatcatcaccatcatcctaggtgggttggcatgccgatgggcaaactgcatgttaatggcaaaaatctggtcaacagcaataatcaaccggttctgctgaatggctggcatcaaccgtcaggcgcatattggacatatcaagattcaaactattatctgaacctgcatggcaataatagacatgcagcaacactggcatatctgaaagatatcacagatacatttgcagacacgtcaccgaaatatggctcaaatcatggctggaatatgaatcaggtccgcctgtttattgatagacaagatatgggagatgttgcagcaggcacatataactttgcaggcgttcaaacagttacacagaatgtcattattccgtatatccagtatgcgaaaagcaaaggcgtttatgttgttctgggcctggattttacactgaaagatgaccaagcaacaacaccggcaaatctgcagaaatttaacgaaatttggggctatcttgcaagcagaccggaaatcaaatcagcagataatgtccactttgaactgattaacgaaccggttaaaagctatgcaaatggacattggggaggctataatggcgaaaatgattttgtcgatcattggaatgatctgcgcaattttcagaacagcatgattagcacaattcgctcaaaaggcgctgataatgttatttgggcagcaggcctgggctataatcagttttattcactgacagcatcacatccgctgacagatccgctgaataactatggctatgcagttcattggtatccgggatatggcgcatatgataactttagcattctgcaggatcagtggaacacaaatgttaaagcagcagcggataaatacccgattaacattacggaagtcacgtggtttaaaaacaaacctggcgattcagcgtattggaatctttttaatggcagcaatgaaggctttggcacaaacacaaaaacgatctttaatgcggcaggcaatgtttcaattgcggcacatatgaatggctttattctgtcagaaggaccgagatcaagctttgcagatccgacagcaggactgaaatgggatggcgacgcatcaagatcagcaatgggcagatttctgtttaactggtatcatgaaagagcgcaaacatatcctggcggaggccaaggcggaccgacaacaggcctggtttcaggcgcaacatacaaaattgttgcacgccatagcaacaaagtcattgatgtccctggcggacagaatgaaaacaatctgcaactgcaacaatggtcagatctgggaggcaatccgcaaaaatgggttctgacatcaattggctcaggcaattatacactgacatcagttaattcaccggataaagtcatcgatattcgcaatggcacactgacaaatggcgaagcagttcaacttatgagcaatctgaatacaacagcgcagcattttaaagtcaatgatctgggaaatggctattggagcattattaacgtgaactccaacaaagcaattgaagttgcaaatgcgtcaacatcagatggcgcaaaacttcaacagaatacatatacaggcgctacaaaccagcaatggaaatttgttgcggtcagcaactaa

SEQ ID NO: 123 - protein, 572 aa, Artificial sequence
  Synthetic Construct
MKKPLGKIVASTALLISVAFSSSIASAHHHHHHPRWVGMPMGKLHVNGKNLVNSNNQPVLLNGWHQPSGAYWTYQDSNYYLNLHGNNRHAATLAYLKDITDTFADTSPKYGSNHGWNMNQVRLFIDRQDMGDVAAGTYNFAGVQTVTQNVIIPYIQYAKSKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILSEGPRSSFADPTAGLKWDGDASRSAMGRFLFNWYHERAQTYPGGGQGGPTTGLVSGATYKIVARHSNKVIDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGAKLQQNTYTGATNQQWKFVAVSN

SEQ ID NO: 124 - protein, 545 aa, Artificial sequence
  Synthetic construct
  mat_peptide (1)..(545)
HHHHHHPRWVGMPMGKLHVNGKNLVNSNNQPVLLNGWHQPSGAYWTYQDSNYYLNLHGNNRHAATLAYLKDITDTFADTSPKYGSNHGWNMNQVRLFIDRQDMGDVAAGTYNFAGVQTVTQNVIIPYIQYAKSKGVYVVLGLDFTLKDDQATTPANLQKFNEIWGYLASRPEIKSADNVHFELINEPVKSYANGHWGGYNGENDFVDHWNDLRNFQNSMISTIRSKGADNVIWAAGLGYNQFYSLTASHPLTDPLNNYGYAVHWYPGYGAYDNFSILQDQWNTNVKAAADKYPINITEVTWFKNKPGDSAYWNLFNGSNEGFGTNTKTIFNAAGNVSIAAHMNGFILSEGPRSSFADPTAGLKWDGDASRSAMGRFLFNWYHERAQTYPGGGQGGPTTGLVSGATYKIVARHSNKVIDVPGGQNENNLQLQQWSDLGGNPQKWVLTSIGSGNYTLTSVNSPDKVIDIRNGTLTNGEAVQLMSNLNTTAQHFKVNDLGNGYWSIINVNSNKAIEVANASTSDGAKLQQNTYTGATNQQWKFVAVSN

SEQ ID NO: 125 - DNA, 1698 bp, Unknown
  Compost metagenome
  CDS (1)..(1695)
  sig_peptide (1)..(87)
  mat_peptide (88)..(1695)
atgaaagcaagttggtccatcaagctgttgctgctgatggcgttaatcatgacgccgattctggtgaatgggaagtcggccgatgcttggtcaggcatgccgatgtccaagctgcacgtcagcggcaaacagctcgtgaacagcagcgggcagcctgttctgctcagcggctggcatcagccatcagggccttattggacgtatcagaacagcaattattacctgagtcagaatggcaacaatcggcatgcggcaattctcgcatatttgaaagacatcactgacaccttcacggacacttcagcgaagtatggcagtacgcacggctggtatatgaaccaggtacgtctattcatcgaccgggaagacatgggcgacgtagcggcgggaacgtacaatttcgcaggcttgaagagcgtgacgcagaatgtgattattccgtacattaattatgccaaaaccaagggcttgtatgttacgctcggccttgacttcactctccaggacaataaagcgacgacgtcatcgaatctggccaagtttaatgaaatttggggctacctcgcttcgcagacgggtatcaagagtgcagataatgtgatgttcgagctcatcaatgagccggtgctctccgatgtgaacggcgtatggggcggcaatccgtcgcaatccaatttcgtcgactactggaattcgttgaggaatttccagaattcgatcatctcgacgattcggagcaaaggggcggataatgtcatctgggcggcaggacttggatgggaccaatactatcagctgtgcgcatcccatccgctgacggatccgctgaacaatctcggttattcggttcactggtatccgggttatggtgcgaatgacaatttctcaacgctgcagcaaatttggaatacaacaatcaagccttgtgcggataactacccgatcaacattacagagacaacttggtttaagcggaaggctggcgattctgattattggaacctgttcaacggctcgaacgagggcttcggcaagaatacgaaagcaatcttcacggctgcaggcaacgtcagcattgcagcgcatatgaatggcttcattctcaaccctggtacgcgaagctcgttcgctgatccgacagcaggcttgcagtacgatggcgatgcgacacgcgacggcatggcgcgtttcctcttcgaatggtactatgagcgcgctcagttcaatccttggaacggcgtttggaatggactcacgaacggcggaacatacaaattggtcaatcgtgcttcgggcaaggtgatcgatgtgcctggcggccagaatacgaatgcgctgcagctgcagcagtatgcggataatggtgcaacggcgcagcaatgggtaattacggaccaaggcacgtacaataatttctacaaattgaccagcgtaagctcgtccgatggcaaagtgatggatgtgcgcaatggaacctccaataatggagaagcgattcagctgatgcagagctttaacaatacggctcaacagttccgattgatcaagctgagtaatgggtactattgcgttctcaatgttaacagcaacaaggctgtagaggttgcgaacgcctcaacctcgaatggcgcgctgattcaacagaactggtatcggggcgacctcaatcaacaatggcagctggttaaaatcaattaa

SEQ ID NO: 126 - protein, 565 aa, Unknown
  Synthetic Construct
MKASWSIKLLLLMALIMTPILVNGKSADAWSGMPMSKLHVSGKQLVNSSGQPVLLSGWHQPSGPYWTYQNSNYYLSQNGNNRHAAILAYLKDITDTFTDTSAKYGSTHGWYMNQVRLFIDREDMGDVAAGTYNFAGLKSVTQNVIIPYINYAKTKGLYVTLGLDFTLQDNKATTSSNLAKFNEIWGYLASQTGIKSADNVMFELINEPVLSDVNGVWGGNPSQSNFVDYWNSLRNFQNSIISTIRSKGADNVIWAAGLGWDQYYQLCASHPLTDPLNNLGYSVHWYPGYGANDNFSTLQQIWNTTIKPCADNYPINITETTWFKRKAGDSDYWNLFNGSNEGFGKNTKAIFTAAGNVSIAAHMNGFILNPGTRSSFADPTAGLQYDGDATRDGMARFLFEWYYERAQFNPWNGVWNGLTNGGTYKLVNRASGKVIDVPGGQNTNALQLQQYADNGATAQQWVITDQGTYNNFYKLTSVSSSDGKVMDVRNGTSNNGEAIQLMQSFNNTAQQFRLIKLSNGYYCVLNVNSNKAVEVANASTSNGALIQQNWYRGDLNQQWQLVKIN

SEQ ID NO: 127 - protein, 536 aa, Unknown
  Compost metagenome
  mat_peptide (1)..(536)
WSGMPMSKLHVSGKQLVNSSGQPVLLSGWHQPSGPYWTYQNSNYYLSQNGNNRHAAILAYLKDITDTFTDTSAKYGSTHGWYMNQVRLFIDREDMGDVAAGTYNFAGLKSVTQNVIIPYINYAKTKGLYVTLGLDFTLQDNKATTSSNLAKFNEIWGYLASQTGIKSADNVMFELINEPVLSDVNGVWGGNPSQSNFVDYWNSLRNFQNSIISTIRSKGADNVIWAAGLGWDQYYQLCASHPLTDPLNNLGYSVHWYPGYGANDNFSTLQQIWNTTIKPCADNYPINITETTWFKRKAGDSDYWNLFNGSNEGFGKNTKAIFTAAGNVSIAAHMNGFILNPGTRSSFADPTAGLQYDGDATRDGMARFLFEWYYERAQFNPWNGVWNGLTNGGTYKLVNRASGKVIDVPGGQNTNALQLQQYADNGATAQQWVITDQGTYNNFYKLTSVSSSDGKVMDVRNGTSNNGEAIQLMQSFNNTAQQFRLIKLSNGYYCVLNVNSNKAVEVANASTSNGALIQQNWYRGDLNQQWQLVKIN

SEQ ID NO: 128 - DNA, 1716 bp, Artificial sequence
  Synthetic construct
  CDS (1)..(1713)
  sig_peptide (1)..(81)
  mat_peptide (82)..(1713)
atgaagaaaccgttggggaaaattgtcgcaagcaccgcactactcatttctgttgcttttagttcatcgatagcatcagcacatcatcatcaccatcatcctaggtggtctggcatgccaatgagcaagcttcatgtttcaggcaagcaacttgttaactcttctggccaacctgttcttctttctggctggcatcaaccttctggcccttactggacttaccaaaactctaactactacctttctcaaaacggcaacaaccgccacgctgctatccttgcttatcttaaggacatcactgacactttcacagacacttctgcaaagtacggctctacacatggctggtacatgaaccaagttcgccttttcatcgaccgcgaggacatgggcgacgtagcagcaggcacttacaacttcgcaggccttaagagcgttacgcaaaacgtaatcatcccttacatcaactacgctaagactaagggcctttacgtaactcttggccttgacttcactcttcaagacaacaaggctactacatcttctaaccttgcaaagttcaacgagatctggggctaccttgcgtctcagacaggcatcaagtctgctgacaacgtaatgttcgagcttatcaacgagccagttcttagcgacgttaacggcgtttggggtggcaacccatcacaaagcaacttcgttgactactggaactctcttcgcaacttccaaaactctatcatctctactatccgctcaaaaggtgcggacaacgttatctgggcagctggccttggctgggaccagtattaccaactttgtgcatctcaccctcttacagaccctcttaacaaccttggctactcagtacactggtatcctggctatggcgctaacgacaacttctcaactcttcaacaaatctggaacactactatcaagccttgtgcggacaactaccctatcaacatcacggagacaacttggttcaagcgcaaggctggcgacagcgactactggaaccttttcaacggcagcaacgagggcttcggcaagaacacaaaggctatcttcactgctgctggcaacgtttctatcgctgctcatatgaacggcttcatccttaacccaggcacgcgctcttctttcgctgacccaactgctggccttcaatacgacggcgacgcaactcgcgacggcatggcacgcttccttttcgagtggtactatgaacgtgcgcaattcaacccatggaacggcgtttggaacggccttactaatggtggcacgtataagcttgttaatcgcgcaagcggcaaggttatcgacgttcctggtggccaaaacacaaacgcacttcaacttcaacagtacgctgacaatggcgcaacagcgcaacaatgggttatcacggaccaaggcacttacaacaacttctataagcttacatctgtatcttcttctgacggcaaggtaatggacgtacgcaacggcacttcaaacaacggcgaggcaatccaacttatgcaaagcttcaacaacactgctcaacaattccgccttatcaagctttctaacggctactactgcgtacttaacgttaacagcaacaaggcagtagaggttgcaaacgcttcaactagcaatggtgcgcttatccaacaaaactggtatcgtggcgaccttaaccagcaatggcagcttgtaaagatcaactaa

SEQ ID NO: 129 - protein, 571 aa, Artificial sequence
  Synthetic Construct
MKKPLGKIVASTALLISVAFSSSIASAHHHHHHPRWSGMPMSKLHVSGKQLVNSSGQPVLLSGWHQPSGPYWTYQNSNYYLSQNGNNRHAAILAYLKDITDTFTDTSAKYGSTHGWYMNQVRLFIDREDMGDVAAGTYNFAGLKSVTQNVIIPYINYAKTKGLYVTLGLDFTLQDNKATTSSNLAKFNEIWGYLASQTGIKSADNVMFELINEPVLSDVNGVWGGNPSQSNFVDYWNSLRNFQNSIISTIRSKGADNVIWAAGLGWDQYYQLCASHPLTDPLNNLGYSVHWYPGYGANDNFSTLQQIWNTTIKPCADNYPINITETTWFKRKAGDSDYWNLFNGSNEGFGKNTKAIFTAAGNVSIAAHMNGFILNPGTRSSFADPTAGLQYDGDATRDGMARFLFEWYYERAQFNPWNGVWNGLTNGGTYKLVNRASGKVIDVPGGQNTNALQLQQYADNGATAQQWVITDQGTYNNFYKLTSVSSSDGKVMDVRNGTSNNGEAIQLMQSFNNTAQQFRLIKLSNGYYCVLNVNSNKAVEVANASTSNGALIQQNWYRGDLNQQWQLVKIN

SEQ ID NO: 130 - protein, 544 aa, Artificial sequence
  Synthetic construct
  mat_peptide (1)..(544)
HHHHHHPRWSGMPMSKLHVSGKQLVNSSGQPVLLSGWHQPSGPYWTYQNSNYYLSQNGNNRHAAILAYLKDITDTFTDTSAKYGSTHGWYMNQVRLFIDREDMGDVAAGTYNFAGLKSVTQNVIIPYINYAKTKGLYVTLGLDFTLQDNKATTSSNLAKFNEIWGYLASQTGIKSADNVMFELINEPVLSDVNGVWGGNPSQSNFVDYWNSLRNFQNSIISTIRSKGADNVIWAAGLGWDQYYQLCASHPLTDPLNNLGYSVHWYPGYGANDNFSTLQQIWNTTIKPCADNYPINITETTWFKRKAGDSDYWNLFNGSNEGFGKNTKAIFTAAGNVSIAAHMNGFILNPGTRSSFADPTAGLQYDGDATRDGMARFLFEWYYERAQFNPWNGVWNGLTNGGTYKLVNRASGKVIDVPGGQNTNALQLQQYADNGATAQQWVITDQGTYNNFYKLTSVSSSDGKVMDVRNGTSNNGEAIQLMQSFNNTAQQFRLIKLSNGYYCVLNVNSNKAVEVANASTSNGALIQQNWYRGDLNQQWQLVKIN

What is claimed is:

1. A granule comprising a core particle and one or more coatings, wherein the core particle comprises a polypeptide having xylanase activity, wherein the polypeptide is selected from the group consisting of:
   (a) a polypeptide comprising the amino acid sequence of SEQ ID NO: 3;
   (b) a polypeptide comprising the amino acid sequence of SEQ ID NO: 3 and a N-terminal and/or C-terminal His-tag and/or HQ-tag; and
   (c) a fragment of the amino acid sequence of SEQ ID NO: 3, wherein the fragment has at least 90% of the length of the amino acid sequence of SEQ ID NO: 3, and wherein the fragment has xylanase activity.

2. A composition comprising the granule of claim 1 and a formulating agent.

3. The composition of claim 2, further comprising one or more additional enzymes.

4. The composition of claim 2, further comprising one or more microbes.

5. The composition of claim 2, further comprising plant based material from the sub-family Panicoideae.

6. An animal feed additive comprising the granule of claim 1 and one or more components selected from the group consisting of:
   one or more vitamins;
   one or more minerals;
   one or more amino acids; and
   one or more other feed ingredients.

7. An animal feed comprising the granule of claim 1 and plant based material from the sub-family Panicoideae.

8. A method of improving the performance of an animal comprising administering to the animal plant based material from the sub-family Panicoideae and the granule of claim 1, wherein the plant based material from the sub-family Panicoideae and the granule are added together or separately, and wherein said improving the performance is an increase in body weight gain, an improved feed conversion ratio, an increased feed efficiency, and combinations thereof.

9. A method of preparing an animal feed comprising mixing the granule of claim 1 with plant based material from the sub-family Panicoideae.

10. A method for improving the nutritional value of an animal feed, comprising treating the animal feed comprising plant based material from the sub-family Panicoideae with the granule of claim 1.

11. A method of releasing xylose from plant based material, comprising treating plant based material from the sub-family Panicoideae with the granule of claim 1.

12. The method of claim 11, wherein the percentage solubilised xylose is at least 3% when the method is performed under the reaction conditions 10 mg polypeptide per kg defatted destarched maize (DFDSM) and incubation at 40° C., pH 5 for 4 hours.

* * * * *